(12) United States Patent
Feinstein et al.

(10) Patent No.: US 8,278,287 B2
(45) Date of Patent: Oct. 2, 2012

(54) SIRNA COMPOUNDS FOR INHIBITING NRF2

(75) Inventors: Elena Feinstein, Rehovot (IL); Igor Mett, Rehovot (IL); Hagar Kalinski, Rishon-le-Zion (IL)

(73) Assignee: Quark Pharmaceuticals Inc., Fremont, CA (US)

( * ) Notice: Subject to any disclaimer, the term of this patent is extended or adjusted under 35 U.S.C. 154(b) by 18 days.

(21) Appl. No.: 12/988,307

(22) PCT Filed: Apr. 6, 2009

(86) PCT No.: PCT/IL2009/000387
§ 371 (c)(1),
(2), (4) Date: Jan. 5, 2011

(87) PCT Pub. No.: WO2009/144704
PCT Pub. Date: Dec. 3, 2009

(65) Prior Publication Data
US 2011/0105591 A1    May 5, 2011

Related U.S. Application Data

(60) Provisional application No. 61/124,196, filed on Apr. 15, 2008, provisional application No. 61/194,495, filed on Sep. 25, 2008.

(51) Int. Cl.
A61K 31/70 (2006.01)
C07H 21/02 (2006.01)
C07H 21/04 (2006.01)
(52) U.S. Cl. ............ 514/44 A; 536/24.1; 536/24.5
(58) Field of Classification Search ............ 514/44; 536/24.1, 24.5
See application file for complete search history.

(56) References Cited

U.S. PATENT DOCUMENTS

| | | |
|---|---|---|
| 5,753,789 A | 5/1998 | Chu et al. |
| 5,874,277 A | 2/1999 | Shintani et al. |
| 5,891,683 A | 4/1999 | Usman et al. |
| 5,898,031 A | 4/1999 | Crooke |
| 5,998,203 A | 12/1999 | Matulic-Adamic et al. |
| 6,068,990 A | 5/2000 | Shintani et al. |
| 6,107,094 A | 8/2000 | Crooke |
| 6,117,657 A | 9/2000 | Usman et al. |
| 6,235,886 B1 | 5/2001 | Manoharan et al. |
| 6,251,666 B1 | 6/2001 | Beigelman |
| 6,268,490 B1 | 7/2001 | Imanishi et al. |
| 6,506,559 B1 | 1/2003 | Fire |
| 6,586,238 B1 | 7/2003 | Matulic-Adamic et al. |
| 6,602,858 B2 | 8/2003 | Beigelman |
| 7,056,704 B2 | 6/2006 | Tuschl et al. |
| 7,078,196 B2 | 7/2006 | Tuschl et al. |
| 7,335,765 B2 | 2/2008 | Kaneko et al. |
| 7,452,987 B2 | 11/2008 | Giese et al. |
| 7,749,977 B2 | 7/2010 | Yehiely et al. |
| 7,812,002 B2 | 10/2010 | Feinstein |
| 7,893,245 B2 | 2/2011 | Giese et al. |
| 8,090,542 B2 | 1/2012 | Khvorova et al. |
| 8,097,710 B2 | 1/2012 | Baulcombe et al. |
| 2002/0164576 A1 | 11/2002 | Pederson et al. |
| 2003/0027783 A1 | 2/2003 | Zernicka-Goetz et al. |
| 2003/0108923 A1 | 6/2003 | Tuschl et al. |
| 2004/0005579 A1 | 1/2004 | Birse et al. |
| 2004/0219569 A1 | 11/2004 | Yehiely et al. |
| 2004/0229266 A1 | 11/2004 | Tuschl et al. |
| 2004/0265839 A1 | 12/2004 | Mello et al. |
| 2005/0004064 A1 | 1/2005 | Tei et al. |
| 2005/0020525 A1 | 1/2005 | McSwiggen et al. |
| 2005/0037988 A1 | 2/2005 | Zamore et al. |
| 2005/0080246 A1 | 4/2005 | Allerson et al. |
| 2005/0181382 A1 | 8/2005 | Zamore et al. |
| 2005/0223427 A1 | 10/2005 | Leake et al. |
| 2006/0058266 A1 | 3/2006 | Manoharan et al. |
| 2006/0217331 A1 | 9/2006 | Vargeese et al. |
| 2006/0292586 A1 | 12/2006 | Schroth et al. |
| 2006/0293511 A1 | 12/2006 | Dellinger |
| 2007/0031844 A1 | 2/2007 | Khvorova et al. |
| 2007/0042418 A1 | 2/2007 | Yehiely et al. |
| 2007/0098728 A1 | 5/2007 | Pedersen et al. |
| 2007/0185047 A1 | 8/2007 | Bhat et al. |
| 2009/0215864 A1 | 8/2009 | Feinstein |
| 2010/0047368 A1 | 2/2010 | Biswal et al. |
| 2010/0215588 A1 | 8/2010 | Skaliter |
| 2010/0292301 A1 | 11/2010 | Feinstein et al. |
| 2011/0105591 A1 | 5/2011 | Feinstein et al. |
| 2011/0112168 A1 | 5/2011 | Feinstein et al. |
| 2011/0230543 A1 | 9/2011 | Feinstein |

FOREIGN PATENT DOCUMENTS

| | | |
|---|---|---|
| EP | 0540742 A1 | 5/1993 |
| WO | WO 99/14226 | 3/1999 |
| WO | WO 00/44895 | 8/2000 |
| WO | WO 00/44914 | 8/2000 |
| WO | WO 01/68836 | 9/2001 |
| WO | WO 03/064621 | 8/2003 |
| WO | WO 03/070918 | 8/2003 |
| WO | WO 03/074654 | 9/2003 |

(Continued)

OTHER PUBLICATIONS

International Search Report issued by the International Searching Authority (ISA/US) on Apr. 2, 2010 in connection with PCT International Application No. PCT/IL2009/000387.
Written Opinion of the International Searching Authority issued on Apr. 2, 2010 in connection with PCT International Application No. PCT/IL2009/000387, filed Apr. 6, 2009.
International Preliminary Report on Patentability, including an International Preliminary Report on Patentability and Written Opinion of the International Searching Authority date of mailing Oct. 28, 2010.
AB162435, Bos Taurus nrf2 mRNA for NF-E2-related factor-2, complete cds. Dec. 21, 2004. <http://www.ncbi.nlm.nih.gov/nuccore/56744173>.

(Continued)

Primary Examiner — Terra Cotta Gibbs
(74) Attorney, Agent, or Firm — John P. White; Cooper & Dunham LLP

(57) ABSTRACT

The present invention provides chemically modified siRNA compounds that target the Nrf2 gene and pharmaceutical compositions comprising same useful for treating or preventing the incidence or severity of a cancerous disease, particularly various lung cancers.

21 Claims, No Drawings

FOREIGN PATENT DOCUMENTS

| | | |
|---|---|---|
| WO | WO 2006/128041 | 11/2006 |
| WO | WO 2006/129881 A1 | 12/2006 |
| WO | WO 2007/087451 | 8/2007 |
| WO | WO 2008/114262 | 9/2008 |
| WO | WO 2008/124660 | 10/2008 |

OTHER PUBLICATIONS

Gong, P & Cederbaum, A (2006). Nrf2 is Increased by CYP2E1 in Rodent Liver and HepG2 Cells and Protects Against Oxidative Stress Caused by CYP2E1 Hepatology, 43, 144-153.

Amarzguioui et al., (2003) "Tolerance for Mutations and Chemical Modifications in a siRNA". Nucleic Acids Research, 31(2):589-95.

Barik, (2005) "Silence of the Transcripts; RNA Interference in Medicine". Mol. Med 2005, 83:764-773.

Braasch et al., (2003) "RNA Interference in Mammalian Cells by Chemically-Modified RNA". Biochemistry, 42:7967-7975.

Caplen et al., (2001) "Specific Inhibition of Gene Expression by Small Double-Stranded RNAs in Invertebrate Vertebrate Systems". Proc. Natl. Acad. Sci., 98(17):9742-9747.

Chakraborty (2007) "Potentiality of Small Interfering RNAs-(siRNA)as Recent Therapeutic Targets for Gene-Silencing". Current Drug Targets, vol. 8(3):469-82.

Chiu et al., (2003) "siRNA Function in RNAi: a Chemical Modification Analysis". RNA, 9(9):1034-48.

Czauderna et al., (2003) "Structural Variations and Stabilising Modifications of Synthetic siRNAs in Mammalian Cells". Nucleic Acids Research, 31(11):2705-16.

Damha et al., (1991) "Oligonucleotides containing unnatural L-2'—deoxyribose". Tetrahedron Letters, 32(23):2573-76.

Elbashir et al., (2001) "RNA Interference is Mediated by 21-and 22-nucleotide RNAs". Genes & Development, 15:188-200.

Elbashir et al., (2001) "Functional Anatomy of siRNAs for Mediating Efficient RNAi in *Drosophila melanogaster* Embryo Lysate". EMBO Journal, 20(23):6877-88.

Elbashir et al., (2001) "Duplexes of 21-nucleotide Mediated RNA Interference in Cultured Mammalian Cells". Nature 411:494-498.

Elmen et al. (2005) "Locked Nucleic Acid (LNA) Mediated Improvements in siRNA Stability and Functionality". NAR, 33(1):439-47.

Fire et al., (1998) "Potent and Specific Genetic Interference by Double-Stranded RNA in *Caenorhabditis elegans*". Nature, vol. 391:806-811.

Holen et al., (2002) "Positional Effects of Short Interfering RNAs Targeting the Human Coagulation Trigger Tissue Factor". NAR, 30(8):1757-66.

Kotlo, et al (2003) "Nrf2 is an inhibitor of the Fas pathway as identified by Achilles Heel Method, a new function-based approach to gene identification in human cells". Oncogene, 22: 797-806.

Mahato et al., (2005) "Modulation of Gene Expression by Antisense and Antigene Oligodeoxynucleotides and Small Interfering RNA". Expert Opinion on Drug Delivery, 2(1):3-28.

McManus et al., (2002) "Gene Silencing in Mammals by Small Interfering RNAs". Nature Reviews Genetics, vol. 3:737-747.

Prakash et al., (2005) "Positional Effect of Chemical Modifications on Short Interference RNA Activity in Mammalian Cells". J. Med Chem, 48(13)4247-53.

Scherer and Rossi (2004) "Therapeutic Applications of RNA Interferences: Recent Advances in siRNA Design". Advances in Genetics, 22:1-21.

Singh et al. (2008) "RNAi-Mediated Silencing of Nuclear Factor Erythroid-2-related Factor 2 Gene Expression in Non-Small Cell Lung Cancer Inhibits Tumor Growth and Increases Efficacy of Chemotherapy". Cancer Res. , 68(19) 7975-84.

Sioud et al . , (2004) "Potential Design Rules and Enzymatic Synthesis of siRNAs". Methods in Molec Biol. , 252 :457-468.

Ui-Tei at al . , (2006) "Essential Notes Regarding the Design of Functional siRNAs for Efficient Mammalian RNAi". J Biomed Biotechnol, 2006:65052.

Ui-Tei et al., (2008) "DNA-modified siRNA-dependent Gene Silencing with reduced Off-target Effect is Induced through a Pathway Parallel to that for siRNA-mediated RNA Interference". Proc 2008 Micro-NanoMechatronics and Human Science (MHS2008), 339-345.

Ui-Tei et al., (2008) "Functional Dissection of siRNA Sequence by Systematic DNA Substitution: Modified siRNA with a DNA Seed Arm is a Powerful Tool for Mammalian Gene Silencing with Significantly Reduced Off-target Effect". Nucleic Acids Research, 36 (7) :2136-51.

Urata et al., (1992) "Synthesis and Properties of Mirror-image DNA". Nucleic Acids Research, 20 (13) 3325-3332.

Zamore, et al., "RNAi: Double-Stranded RNA Directs the ATP-Dependent Cleavage of mRNA at 21 to 23 Nucleotide Intervals". Cell, (2000), 101:25-33.

Garbesi et al. (1993) "L-DNAs as Potential Antimessenger Oligonucleotides: A Reassessment". Nuc. Acids Res., 21 (18) :4159-65.

Kawakimi et al. (2005) "Thermodynamic Analysis of Duplex Formation of Heterochiral DNA with L-deoxyadenosine" . Analyt. Sci., Feb. 2005 (21): 77-82.

Kim et al. (2007) "Superior Structure Stability and Selectivity of Hairpin Nucleic Acid Probes with an L-DNA Stem". Nuc. Acids Res., 35 (21): 7279-7287.

Written Opinion issued by the International Searching Authority (ISA/US) on Jan. 8, 2009 in connection with International Application PCT/IL2008/000391 (WO 2008/114262).

International Preliminary Report on Patentability issued by the International Searching Authority (ISA/US) on Jan. 28, 2010 in connection with International Application PCT/IL2008/000391 (WO 2008/114262).

SIRNA COMPOUNDS FOR INHIBITING NRF2

This application is a §371 national stage of PCT International Application No. PCT/IL2009/000387, filed Apr. 6, 2009, and claims the benefit of U.S. Provisional Application Nos. 61/194,495, filed Sep. 25, 2008 and 61/124,196, filed Apr. 15, 2008, which are hereby incorporated by reference in their entirety.

This application incorporates-by-reference nucleotide and/or amino acid sequences which are present in the file named "101015_SubstituteSequenceListing_DES.txt," which is 2 megabytes in size, and which was created Oct. 15, 2010 in the IBM-PC machine format, having an operating system compatibility with MS-Windows, which is contained in the text file filed Oct. 15, 2010 as part of this application.

Throughout this application various patent and scientific publications are cited. The disclosures for these publications in their entireties are hereby incorporated by reference into this application to more fully describe the state of the art to which this invention pertains.

FIELD OF THE INVENTION

The present invention provides sense and antisense oligonucleotides useful in synthesis of chemically modified siRNA compounds that target the NRF2 gene (NFE2L2) and pharmaceutical compositions comprising same having utility in treating or preventing the incidence or severity of proliferative diseases, particularly lung cancers.

BACKGROUND OF THE INVENTION

The Nrf2 Gene and Polypeptide

Nuclear factor erythroid-2 related factor 2 (NFE2L2; Nrf2), a cap-and-collar basic leucine zipper transcription factor, positively regulates a transcriptional program that maintains cellular redox homeostasis and protects cells from oxidative insult, including insult from chemotherapeutic agents (Rangasamy, et al. 2004. J Clin Invest 114, 1248). Nrf2 activates transcription of its target genes through binding specifically to the antioxidant-response element (ARE) found in those genes' promoters. The Nrf2-regulated transcriptional program includes a broad spectrum of genes, including antioxidants such as heme oxygenase-1, superoxide dismutase, glutathione reductase (GSR), glutathione peroxidase, thioredoxin, thioredoxin reductase, and peroxiredoxins (PRDX).

Lung Cancer

Lung cancer usually develops in the cells lining the lung's air passages. The two main types are small cell lung cancer (SCLC) and non-small cell lung cancer (NSCLC), based on the cell morphology. In non-small cell lung cancer, results of standard treatment are poor except for the most localized cancers. Surgery is the most potentially curative therapeutic option for this disease; radiation therapy can produce a cure in only a small number of patients and can provide palliation in most patients. Adjuvant chemotherapy may provide an additional benefit to patients with resected NSCLC. In advanced-stage disease, chemotherapy offers modest improvements in median survival, though overall survival is poor. Chemotherapy has produced short-term improvement in disease-related symptoms. Other forms of lung cancer include metastases of a primary cancer.

PCT Patent Publication No. WO 2006/128041 discloses siRNA molecules for Nrf2 and their use in treating cancer, preferably lung and kidney cancers. US Patent Application Publication No. 20020164576 discloses a method of inhibiting tumor growth (preferably a lymphoma cancer) using antisense molecules directed to Nrf2 or specific antibodies. Co-assigned US Patent Application Publication No. 20070042418, discloses the use of Nrf2 inhibitors including siRNA molecules for treating cancer. Co-assigned PCT Patent Publication No. WO 2008/114262 discloses certain Nrf2 siRNA molecules.

siRNA and RNA Interference

RNA interference (RNAi) is a phenomenon involving double-stranded (ds) RNA-dependent gene specific posttranscriptional silencing. Originally, attempts to study this phenomenon and to manipulate mammalian cells experimentally were frustrated by an active, non-specific antiviral defense mechanism which was activated in response to long dsRNA molecules (Gil et al. Apoptosis, 2000. 5:107-114). Later it was discovered that synthetic duplexes of 21 nucleotide RNAs could mediate gene specific RNAi in mammalian cells, without the stimulation of the generic antiviral defense mechanisms (see Elbashir et al. Nature 2001, 411:494-498 and Caplen et al. PNAS USA 2001, 98:9742-9747). As a result, small interfering RNAs (siRNAs), which are short double-stranded RNAs, have become powerful tools in attempting to understand gene function. Thus RNA interference (RNAi) refers to the process of sequence-specific post-transcriptional gene silencing in mammals mediated by small interfering RNAs (siRNAs) (Fire et al, Nature 1998. 391, 806) or microRNAs (miRNA; Ambros, Nature 2004 431: 7006, 350-55; and Bartel, Cell. 2004. 116(2):281-97). The corresponding process in plants is commonly referred to as specific posttranscriptional gene silencing or RNA silencing and is referred to as quelling in fungi.

A siRNA is a double-stranded RNA molecule which inhibits, either partially or fully, the expression of a gene/mRNA of its endogenous or cellular counterpart, or of an exogenous gene such as a viral nucleic acid. The mechanism of RNA interference is detailed infra.

Studies have revealed that siRNA is effective in vivo in mammals, including humans. Bitko et al., showed that specific siRNAs directed against the respiratory syncytial virus (RSV) nucleocapsid N gene are effective in treating mice when administered intranasally (Nat. Med. 2005, 11(1):50-55). For reviews of therapeutic applications of siRNAs see for example Barik (Mol. Med 2005, 83: 764-773) and Chakraborty (Current Drug Targets 2007 8(3):469-82). In addition, clinical studies with short siRNAs that target the VEGFR1 receptor in order to treat age-related macular degeneration (AMD) have been conducted in human patients (Kaiser, Am J Ophthalmol. 2006 142(4)660-8). Further information on the use of siRNA as therapeutic agents is available, see for example Durcan (Mol. Pharma. 2008. 5(4):559-566), Kim and Rossi (BioTechniques 2008. 44:613-616) and Grimm and Kay (JCI, 2007. 117(12):3633-41).

Chemically Modified siRNA

The selection and synthesis of siRNA corresponding to known genes has been widely reported (see for example Ui-Tei et al., 2006. J Biomed Biotechnol. 2006: 65052; Chalk et al., 2004. BBRC. 319(1): 264-74; Sioud & Leirdal, 2004. Met. Mol Biol. 252:457-69; Levenkova et al., 2004, Bioinform. 20(3):430-2; Ui-Tei et al., 2004. NAR 32(3):936-48).

Examples for the use of, and production of, chemically modified siRNA are found in Braasch et al., 2003. Biochem., 42(26):7967-75; Chiu et al., 2003, RNA, 9(9):1034-48; PCT Patent Publications Nos. WO 2004/015107 and WO 02/44321. U.S. Pat. Nos. 5,898,031 and 6,107,094 teach chemically modified oligomers. U.S. Pat. No. 7,452,987 relates to compounds having alternating unmodified and 2' sugar modified ribonucleotides. PCT Patent Application Nos. PCT/IL2008/000248 and PCT/IL2008/001197, assigned to the assignee of the present invention, and hereby incorporated by reference in their entirety, disclose chemically modified siRNA compounds.

Despite the evident progress, there remains a continued need for improved therapeutic molecules, in particular improved Nrf2 siRNA compounds, useful in treating cancerous or proliferative diseases, particularly lung cancers.

SUMMARY OF THE INVENTION

The present invention provides novel double stranded oligonucleotides that inhibit the Nrf2 gene. The invention also provides a pharmaceutical composition comprising one or more such oligonucleotides, and a vector capable of expressing the oligonucleotide. The present invention also relates to methods and compositions for treating or preventing the incidence or severity of a cancerous or proliferative disease, particularly various lung cancers. The methods and compositions involve administering to a mammal in need of such treatment a prophylactically or therapeutically effective amount of one or more oligonucleotide compounds which down-regulate the expression of the Nrf2 gene, particularly novel small interfering RNAs (siRNAs).

In one aspect the present invention provides novel siRNA compounds useful in inhibiting the NRF2 gene.

Accordingly, in one aspect the present invention provides a siRNA compound having the following structure:

5' (N)$_x$—Z 3' (antisense strand)
3' Z'—(N')$_y$-z" 5' (sense strand)

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein z" may be present or absent, but if present is a capping moiety covalently attached at the 5' terminus of (N') y;

each of x and y is independently an integer between 18 and 40;

wherein the sequence of (N')y is substantially complementary to the sequence of (N)x; and wherein (N)x comprises an antisense sequence present in any one of Tables A-H (SEQ ID NOS: 4-8,533). In some embodiments the covalent bond joining each consecutive N or N' to the next N or N' is a phosphodiester bond. In some embodiments (N')y comprises two consecutive N' joined by a PACE bond at the 3' terminus.

In various embodiments x=y and each of x and y is 19, 20, 21, 22 or 23. In some embodiments x=y=19.

In some embodiments (N)x comprises at least five alternating unmodified and modified ribonucleotides beginning at the 3' end and at least nine modified ribonucleotides in total and each remaining N is an unmodified ribonucleotide. In some embodiments the modified ribonucleotide is a 2'-O-methyl (2'OMe) sugar modified ribonucleotide. In some embodiments (N)x comprises modified ribonucleotides in alternating positions wherein each N at the 5' and 3' termini are modified in their sugar residues and the middle ribonucleotide is an unmodified ribonucleotide, e.g. in position 10 in a 19-mer strand.

In various embodiments (N)x comprises 2'OMe sugar modified ribonucleotides at positions 1, 3, 5, 7, 9, 11, 13, 15, 17 and 19. In other embodiments, (N)x comprises 2'OMe sugar modified ribonucleotides at positions 2, 4, 6, 8, 11, 13, 15, 17 and 19.

In some embodiments (N')y comprises at least one mirror nucleotide, or a nucleotide joined to an adjacent nucleotide by a 2'-5' internucleotide phosphate bond.

In one embodiment of the above structure, the compound comprises at least one mirror nucleotide at one terminus or both termini in (N')y. In some embodiments the mirror nucleotide is selected from an L-ribonucleotide and an L-deoxyribonucleotide. In various embodiments the mirror nucleotide is an L-deoxyribonucleotide.

In various embodiments the compound comprises two consecutive mirror nucleotides, one at the 3' penultimate position and one at the 3' terminus in (N')y. In one preferred embodiment x=y=19 and (N')y comprises an L-deoxyribonucleotide at position 18.

In some embodiments y=19 and (N')y, consists of unmodified ribonucleotides at positions 1-17 and 19 and one L-DNA at the 3' penultimate position (position 18). In other embodiments y=19 and (N')y consists of unmodified ribonucleotides at position 1-16 and 19 and two consecutive L-DNA at the 3' penultimate position (positions 17 and 18).

In another embodiment of the above structure, (N')y comprises at least two consecutive nucleotide joined together to the next nucleotide by a 2'-5' phosphodiester bond at one or both termini. In certain preferred embodiments in (N')y the 3' penultimate nucleotide is linked to the 3' terminal nucleotide with a 2'-5' phosphodiester bridge.

In other embodiments of the above structures, (N')y further comprises one or more nucleotides containing a sugar moiety modified with an extra bridge at one or both termini. Non-limiting examples of such nucleotides, also referred to herein as bicyclic nucleotides, are locked nucleic acid (LNA) and ethylene-bridged nucleic acid (ENA).

In certain preferred embodiments the compound of the invention is a blunt-ended (z", Z and Z' are absent), double stranded oligonucleotide structure, wherein x=y=19, wherein (N')y comprises unmodified ribonucleotides in which three consecutive nucleotides at the 3' terminus are joined together by two 2'-5' phosphodiester bonds; and an antisense strand (AS) of alternating unmodified and 2'-O methyl sugar-modified ribonucleotides.

In some embodiments, neither (N)x nor (N')y are phosphorylated at the 3' and 5' termini. In other embodiments either or both (N)x and (N')y are phosphorylated at the 3' termini.

In some embodiments (N)x and its corresponding sense strand (N')y are selected from any one of the oligonucleotide pairs shown in Tables A-H, set forth in SEQ ID NOS: 4-8,533.

In certain embodiments the compound is blunt ended, for example wherein both Z and Z' are absent. In an alternative embodiment, the compound comprises at least one 3' overhang and/or a 5' capping moiety at the 5' terminus of (N')y, wherein at least one of Z or Z' or z" is present. Z, Z' and z" are independently one or more covalently linked modified or non-modified nucleotides, for example inverted dT or dA; dT, LNA, mirror nucleotide and the like. In some embodiments each of Z and Z' are independently selected from dT and dTdT. In certain specific embodiments Z and Z' are absent, z" is present and consists of inverted deoxyabasic moiety.

In a further aspect, the present invention provides a pharmaceutical composition comprising one or more compounds of the present invention, in an amount effective to inhibit target gene expression, and a pharmaceutically acceptable carrier wherein the target gene Nrf2.

Also provided by the present invention are methods and compositions for treating a patient suffering from a cancerous or proliferative disease, (e.g. lung cancer, breast cancer, cervical cancer, colon cancer, gastric cancer, kidney cancer, leukemia, liver cancer, lymphoma, ovarian cancer, pancreatic cancer, prostate cancer, rectal cancer, sarcoma, skin cancer, testicular cancer, and uterine cancer. In one particular embodiment, the cancer is lung cancer including non-small-cell lung carcinoma (NSCLC) or small-cell lung carcinoma. The methods of the invention comprise administering to the patient one or more compounds which down-regulate the expression of the Nrf2 gene, particularly siRNAs that inhibit Nrf2, typically as a pharmaceutical composition, in a therapeutically effective dose so as to thereby treat the patient.

Still further, the invention relates to a method for treating or preventing the incidence or severity of a cancerous or proliferative disease, particularly a lung cancerous disease in a patient comprising administering to the patient a pharmaceutical composition comprising an effective amount of an siRNA molecule of the present invention; and a therapeutically acceptable carrier. Preferably, the siRNA is delivered as naked siRNA. In some embodiments the naked siRNA molecules are applied directly to the lung, for example via aerosol delivery, which has the potential for delivering high concentrations of the therapeutic molecule to the inner lung.

Still further, the invention relates to the use of a therapeutically effective dose of an oligonucleotide for the preparation of a composition for treating a subject suffering from a cancerous or proliferative disease, preferably lung cancer, wherein the oligonucleotide is present in any one of Tables A-H (SEQ ID NOS: 4-8,533).

In yet another aspect the present invention provides a method of sensitizing a cancer cell to a cancer therapy comprising contacting the cell with a double stranded compound according to the present invention wherein the double stranded compound inhibits expression of a Nrf2 polypeptide, thereby sensitizing the cell to the cancer therapy.

In some embodiments the cancer therapy is sleeted from a chemotherapeutic agent, and radiation therapy. In some embodiments the cancer cell is a lung cancer cell.

DETAILED DESCRIPTION OF THE INVENTION

The present invention relates generally to compounds which down-regulate expression of the Nrf2 gene, particularly to unmodified and chemically modified small interfering RNAs (siRNAs), and to the use of these novel siRNAs in the treatment of various diseases and medical conditions, in particular various forms of cancerous or proliferative diseases. Such preferred siRNA compounds comprise sense and corresponding antisense oligonucleotide sequences present in any one of Tables A-H (set forth as SEQ ID NOS: 4-8,533).

More preferred siRNA compounds comprise sense and corresponding antisense oligonucleotide sequences present in any one of Tables H1-H5 (set forth as SEQ ID NOS: 8,490-8,533). The sense and corresponding antisense oligonucleotide siRNA sequences present in Tables A-B (set forth as SEQ ID NOS:4-2,009) are disclosed in copending PCT application PCT/IL2008/000391 (WO2008/114262).

The inventors of the present invention provide novel siRNAs to Nrf2 having utility in treating or preventing any of the diseases or disorders disclosed herein and to pharmaceutical compositions comprising same.

The present invention further provides methods for inhibiting expression of a target Nrf2 gene in vivo. Without being bound to theory, the method includes administering an oligonucleotide, including a small interfering RNA (i.e., siRNA) that targets Nrf2 mRNA and hybridize to, or interacts with, the mRNA under physiological conditions, or a nucleic acid material that produces siRNA in a cell, in an amount sufficient to down-regulate expression of the Nrf2 gene. In some embodiments the Nrf2 gene is down regulated by an RNA interference mechanism. In particular, the subject method is used to inhibit expression of the Nrf2 gene for treatment or prevention of cancer or other disease in which expression of Nrf2 is a contraindication.

In accordance with the present invention, the Nrf2 inhibitors provided herein are used as drugs to treat various pathologies accompanied by an elevated level of Nrf2 polypeptide.

The present invention provides double-stranded oligoribonucleotides (siRNAs), which down-regulate the expression of the Nrf2 gene. In some embodiments the double-stranded oligoribonucleotides further comprises one or more deoxynucleotide, modified deoxynucleotide, modified ribonucleotide or unconventional moiety including a mirror deoxynucleotide. A siRNA of the present invention is a duplex oligoribonucleotide in which the sense strand is derived from the mRNA sequence of the Nrf2 gene, and the antisense strand is fully complementary or substantially complementary to the sense strand. In general, some deviation from the target mRNA sequence is tolerated without compromising the siRNA activity (see e.g. Czauderna et al 2003 Nucleic Acids Research 31(11), 2705-2716). Without being bound by theory, siRNA targets the mRNA for specific cleavage and degradation and/or may inhibit translation from the targeted message.

As used herein, the term "Nrf2 polypeptide" refers to the Nrf2 polypeptide (gi:20149576|ref|NP_006155) or to a homolog thereof having preferably 90% homology, more preferably 95% homology, and even more preferably 98% homology to the Nrf2 polypeptide as either full-length or a fragment or a domain thereof, as a mutant or the polypeptide encoded by a spliced variant nucleic acid sequence, as a chimera with other polypeptides, provided that any of the above has the same or substantially the same biological function as the Nrf2 polypeptide.

As used herein, the term "Nrf2", "Nrf2 mRNA", "Nrf2 gene", "Nrf2 polynucleotide" (gi|166295208|ref|NM_006164.3| Homo sapiens nuclear factor (erythroid-derived 2)-like 2 (NFE2L2)) SEQ ID NOS: 1-3 is defined as any homolog of the Nrf2 polynucleotide having preferably 90% homology, more preferably 95% homology, and even more preferably 98% homology to the Nrf2 mRNA, as either full-length or a fragment or a domain thereof, or as a mutant of the polynucleotide.

siRNA and RNA Interference

RNA interference (RNAi) is a phenomenon involving double-stranded (ds) RNA-dependent gene specific posttranscriptional silencing. Originally, attempts to study this phenomenon and to manipulate mammalian cells experimentally were frustrated by an active, non-specific antiviral defense mechanism which was activated in response to long dsRNA molecules (Gil et al. Apoptosis, 2000. 5:107-114). Later it was discovered that synthetic duplexes of 21 nucleotide RNAs could mediate gene specific RNAi in mammalian cells, without the stimulation of the generic antiviral defense mechanisms (see Elbashir et al. Nature 2001, 411:494-498 and Caplen et al. PNAS USA 2001, 98:9742-9747). As a result, small interfering RNAs (siRNAs), which are short double-stranded RNAs, have become powerful tools in attempting to understand gene function. Thus RNA interference (RNAi) refers to the process of sequence-specific post-transcriptional gene silencing in mammals mediated by small interfering RNAs (siRNAs) (Fire et al, Nature 1998. 391, 806) or microRNAs (miRNA; Ambros, Nature 2004 431: 7006, 350-55; and Bartel, Cell. 2004. 116(2):281-97). The corresponding process in plants is commonly referred to as specific post transcriptional gene silencing or RNA silencing and in fungi is referred to as quelling.

A siRNA is a double-stranded RNA molecule which inhibits, either partially or fully, the expression of a gene/mRNA of its endogenous or cellular counterpart, or of an exogenous gene such as a viral nucleic acid.

siRNA has recently been successfully used for inhibition in primates (Tolentino et al., Retina 2004. 24(1):132-138). Several studies have revealed that siRNA therapeutics are effective in vivo in both mammals and in humans. Bitko et al., have shown that specific siRNA molecules directed against the respiratory syncytial virus (RSV) nucleocapsid N gene are effective in treating mice when administered intranasally (Bitko et al., Nat. Med. 2005, 11(1):50-55). For a review of the use of siRNA as therapeutics, see Barik (J. Mol. Med. 2005. 83: 764-773) and Dykxhoorn, et al (Gene Therapy 2006, 13, 541-552). siRNA oligonucleotides Tables A-H provide nucleic acid sequences of sense and corresponding antisense oligonucleotides, useful in preparing unmodified and chemically modified siRNA compounds of the invention. Antisense and corresponding sense oligonucleotides useful in preparing siRNA according to the present invention are set forth in Tables A-H (SEQ ID NOS: 4-8,533). Throughout the specification, nucleotide positions are numbered from 1 to 19 or 1 to 21 or 1 to 23 and are counted from the 5' end of the antisense or sense oligonucleotides. For example, position 1 on (N)x refers to the 5' terminal nucleotide on the antisense oligonucleotide strand.

According to the present invention the siRNA compounds are chemically and or structurally modified according to one of the following modifications set forth in Structures (A)-(P) or as tandem siRNA or RNAstar.

In one aspect the present invention provides a compound set forth as Structure (A):

(A) 5' $(N)_x$—Z 3' (antisense strand)
3' Z'—$(N')_y$ 5' (sense strand)

wherein each of N and N' is a nucleotide selected from an unmodified ribonucleotide, a modified ribonucleotide, an unmodified deoxyribonucleotide and a modified deoxyribonucleotide;

wherein each of $(N)_x$ and $(N')_y$ is an oligonucleotide in which each consecutive N or N' is joined to the next N or N' by a covalent bond;

wherein each of x and y is an integer between 18 and 40;

wherein each of Z and Z' may be present or absent, but if present is 1-5 consecutive nucleotides covalently attached at the 3' terminus of the strand in which it is present;

wherein the sequence of $(N')_y$ is a sequence substantially complementary to (N)x; and wherein the sequence of $(N)_x$ comprises an antisense sequence substantially identical to an antisense sequence set forth in any one of Tables C-H (SEQ ID NOS: 2010-8,533).

In certain embodiments the present invention provides a compound having structure (B):

(B) 5' (N)x-Z 3' antisense strand
3' Z—'(N')y 5' sense strand wherein each of $(N)_x$ and $(N')_y$ is an oligomer in which each consecutive N or N' is an unmodified ribonucleotide or a modified ribonucleotide joined to the next N or N' by a covalent bond;

wherein each of Z and Z' may be present or absent, but if present is 1-5 consecutive nucleotides covalently attached at the 3' terminus of the strand in which it is present;

wherein each of x and y=19, 21 or 23 and $(N)_x$ and $(N')_y$ are fully complementary wherein alternating ribonucleotides in each of $(N)_x$ and $(N')_y$ are modified to result in a 2'-O-methyl (2'OMe) modification in the sugar residue of the ribonucleotides;

wherein the sequence of $(N')_y$ is a sequence substantially complementary to (N)x; and wherein the sequence of $(N)_x$ comprises an antisense sequence substantially identical to an antisense sequence set forth in any one of Tables C-H (SEQ ID NOS: 2010-8,533).

In some embodiments each of $(N)_x$ and $(N')_y$ is independently phosphorylated or non-phosphorylated at the 3' and 5' termini.

In certain embodiments wherein each of x and y=19 or 23, each N at the 5' and 3' termini of $(N)_x$ is modified; and each N' at the 5' and 3' termini of $(N')_y$ is unmodified.

In certain embodiments wherein each of x and y=21, each N at the 5' and 3' termini of $(N)_x$ is unmodified; and each N' at the 5' and 3' termini of $(N')_y$ is modified.

In particular embodiments, when x and y=19, the siRNA is modified such that a 2'OMe group is present on the first, third, fifth, seventh, ninth, eleventh, thirteenth, fifteenth, seventeenth and nineteenth nucleotide of the antisense strand $(N)_x$, and whereby the very same modification, i.e. a 2'OMe group, is present at the second, fourth, sixth, eighth, tenth, twelfth, fourteenth, sixteenth and eighteenth nucleotide of the sense strand $(N')_y$. In various embodiments these particular siRNA compounds are blunt ended at both termini.

In some embodiments, the present invention provides a compound having Structure (C):

(C) 5' (N)x-Z 3' antisense strand
3' Z'—(N')y 5' sense strand wherein each of N and N' is a nucleotide independently selected from an unmodified ribonucleotide, a modified ribonucleotide, an unmodified deoxyribonucleotide and a modified deoxyribonucleotide;

wherein each of (N)x and (N')y is an oligomer in which each consecutive nucleotide is joined to the next nucleotide by a covalent bond and each of x and y is an integer between 18 and 40;

wherein in (N)x the nucleotides are unmodified or (N)x comprises alternating 2'OMe modified ribonucleotides and unmodified ribonucleotides; and the ribonucleotide located at the middle position of (N)x is 2'OMe modified or unmodified, preferably unmodified;

wherein (N')y comprises unmodified ribonucleotides further comprising one modified nucleotide at a terminal or penultimate position, wherein the modified nucleotide is selected from the group consisting of a mirror nucleotide, a bicyclic nucleotide, a 2'-sugar modified nucleotide, an altritol nucleotide, or a nucleotide joined to an adjacent nucleotide by an internucleotide linkage selected from a 2'-5' phosphodiester bond, a P-alkoxy linkage or a PACE linkage;

wherein if more than one nucleotide is modified in (N')y, the modified nucleotides may be consecutive;

wherein each of Z and Z' may be present or absent, but if present is 1-5 deoxyribonucleotides covalently attached at the 3' terminus of any oligomer to which it is attached;

wherein the sequence of $(N')_y$ comprises a sequence substantially complementary to (N)x; and wherein the sequence of $(N)_x$ comprises an antisense sequence substantially complementary to about 18 to about 40 consecutive ribonucleotides in an mRNA set forth in any one of SEQ ID NOS:1-3. Preferably $(N)_x$ comprises an antisense sequence substantially identical to an antisense sequence set forth in any one of Tables A-H (SEQ ID NOS: 4-8,533).

In particular embodiments, x=y=19 and in (N)x each modified ribonucleotide is modified so as to have a 2'-O-methyl on its sugar and the ribonucleotide located at the middle of (N)x is unmodified. Accordingly, in a compound wherein x=19, (N)x comprises 2'-O-methyl sugar modified ribonucleotides at positions 1, 3, 5, 7, 9, 11, 13, 15, 17 and 19. In other embodiments, (N)x comprises 2'OMe modified ribonucleotides at positions 2, 4, 6, 8, 11, 13, 15, 17 and 19 and may further comprise at least one abasic or inverted abasic unconventional moiety for example in position 5. In other embodiments, (N)x comprises 2'OMe modified ribonucleotides at positions 2, 4, 8, 11, 13, 15, 17 and 19 and may further comprise at least one abasic or inverted abasic unconventional moiety for example in position 6. In other embodiments, (N)x comprises 2'OMe modified ribonucleotides at positions 2, 4, 6, 8, 11, 13, 17 and 19 and may further comprise at least one abasic or inverted abasic unconventional moiety for example in position 15. In other embodiments, (N)x comprises 2'OMe modified ribonucleotides at positions 2, 4, 6, 8, 11, 13, 15, 17 and 19 and may further comprise at least one abasic or inverted abasic unconventional moiety for example in position 14. In other embodiments, (N)x comprises 2'OMe modified ribonucleotides at positions 1, 2, 3, 7, 9, 11, 13, 15, 17 and 19 and may further comprise at least one abasic or inverted abasic unconventional moiety for example in position 5. In other embodiments, (N)x comprises 2'OMe modified ribonucleotides at positions 1, 2, 3, 5, 7, 9, 11, 13, 15, 17 and 19 and may further comprise at least one abasic or inverted abasic unconventional moiety for example in position 6. In other embodiments, (N)x comprises 2'OMe modified ribonucleotides at positions 1, 2, 3, 5, 7, 9, 11, 13, 17 and 19 and may further comprise at least one abasic or inverted abasic unconventional moiety for example in position 15. In other embodiments, (N)x comprises 2'OMe modified ribonucleotides at positions 1, 2, 3, 5, 7, 9, 11, 13, 15, 17 and 19 and may further comprise at least one abasic or inverted abasic unconventional moiety for example in position 14. In other embodiments, (N)x comprises 2'OMe modified ribonucleotides at positions 2, 4, 6, 7, 9, 11, 13, 15, 17 and 19 and may further comprise at least one abasic or inverted abasic unconventional moiety for example in position 5. In other embodiments, (N)x comprises 2'OMe modified ribonucleotides at positions 1, 2, 4, 6, 7, 9, 11, 13, 15, 17 and 19 and may further comprise at least one abasic or inverted abasic unconventional moiety for example in position 5. In other embodiments, (N)x comprises 2'OMe modified ribonucleotides at positions 2, 4, 6, 8, 11, 13, 14, 16, 17 and 19 and may further comprise at least one abasic or inverted abasic unconventional moiety for example in position 15. In other embodiments, (N)x comprises 2'OMe modified ribonucleotides at positions 1, 2, 3, 5, 7, 9, 11, 13, 14, 16, 17 and 19 and may further comprise at least one abasic or inverted abasic unconventional moiety for example in position 15. In other embodiments, (N)x comprises 2'OMe modified ribonucleotides at positions 2, 4, 6, 8, 11, 13, 15, 17 and 19 and may further comprise at least one abasic or inverted abasic unconventional moiety for example in position 7. In other embodiments, (N)x comprises 2'O-Me modified ribonucleotides at positions 2, 4, 6, 11, 13, 15, 17 and 19 and may further comprise at least one abasic or inverted abasic unconventional moiety for example in position 8. In other embodiments, (N)x comprises 2'OMe modified ribonucleotides at positions 2, 4, 6, 8, 11, 13, 15, 17 and 19 and may further comprise at least one abasic or inverted abasic unconventional moiety for example in position 9. In other embodiments, (N)x comprises 2'OMe modified ribonucleotides at positions 2, 4, 6, 8, 11, 13, 15, 17 and 19 and may further comprise at least one abasic or inverted abasic unconventional moiety for example in position 10. In other embodiments, (N)x comprises 2'OMe modified ribonucleotides at positions 2, 4, 6, 8, 13, 15, 17 and 19 and may further comprise at least one abasic or inverted abasic unconventional moiety for example in position 11. In other embodiments, (N)x comprises 2'OMe modified ribonucleotides at positions 2, 4, 6, 8, 11, 13, 15, 17 and 19 and may further comprise at least one abasic or inverted abasic unconventional moiety for example in position 12. In other embodiments, (N)x comprises 2'O-Me modified ribonucleotides at positions 2, 4, 6, 8, 11, 15, 17 and 19 and may further comprise at least one abasic or inverted abasic unconventional moiety for example in position 13.

In yet other embodiments (N)x comprises at least one nucleotide mismatch relative to one of the mRNA disclosed herein, and particularly the mRNA transcribed from the mammalian genes of Table 3. In certain preferred embodiments, (N)x comprises a single nucleotide mismatch on position 5, 6, or 14. In one embodiment of Structure (C), at least two nucleotides at either or both the 5' and 3' termini of (N')y are joined by a 2'-5' phosphodiester bond. In certain preferred embodiments x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; and three nucleotides at the 3' terminus of (N')y are joined by two 2'-5' phosphodiester bonds (set forth herein as Structure I). In other preferred embodiments, x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; and four consecutive nucleotides at the 5' terminus of (N')y are joined by three 2'-5' phosphodiester bonds. In a further embodiment, an additional nucleotide located in the middle position of (N')y may be modified with 2'OMe on its sugar. In another preferred embodiment, in (N)x the nucleotides alternate between 2'OMe modified ribonucleotides and unmodified ribonucleotides, and in (N')y four consecutive nucleotides at the 5' terminus are joined by three 2'-5' phosphodiester bonds and the 5' terminal nucleotide or two or three consecutive nucleotides at the 5' terminus comprise 3'-O-methyl modifications.

In certain preferred embodiments of Structure C, x=y=19 and in (N')y, at least one position comprises an abasic or inverted abasic unconventional moiety, preferably five positions comprises an abasic or inverted abasic unconventional moieties. In various embodiments, the following positions comprise an abasic or inverted abasic: positions 1 and 16-19, positions 15-19, positions 1-2 and 17-19, positions 1-3 and 18-19, positions 1-4 and 19 and positions 1-5. (N')y may further comprise at least one LNA nucleotide.

In certain preferred embodiments of Structure C, x=y=19 and in (N')y the nucleotide in at least one position comprises a mirror nucleotide, a deoxyribonucleotide and a nucleotide joined to an adjacent nucleotide by a 2'-5' internucleotide bond.

In certain preferred embodiments of Structure C, x=y=19 and (N')y comprises a mirror nucleotide. In various embodiments the mirror nucleotide is an L-DNA nucleotide. In certain embodiments the L-DNA is L-deoxyribocytidine. In some embodiments (N')y comprises L-DNA at position 18. In other embodiments (N')y comprises L-DNA at positions 17 and 18. In certain embodiments (N')y comprises L-DNA substitutions at positions 2 and at one or both of positions 17 and 18. In certain embodiments (N')y further comprises a 5' terminal cap nucleotide such as 5'-O-methyl DNA or an abasic or inverted abasic moiety as an overhang.

In yet other embodiments (N')y comprises a DNA at position 15 and L-DNA at one or both of positions 17 and 18. In that structure, position 2 may further comprise an L-DNA or an abasic unconventional moiety.

Other embodiments of Structure C are envisaged wherein x=y=21 in these embodiments the modifications for (N')y discussed above instead of being on positions 15, 16, 17, 18 are on positions 17, 18, 19, 20 for 21-mer.; similarly the modifications at one or both of positions 17 and 18 are on one or both of positions 19 or 20 for the 21-mer. All modifications in the 19-mer are similarly adjusted for the 21- and 23-mer.

According to various embodiments of Structure (C), in (N')y 2, 3, 4, 5, 6, 7, 8, 9, 10, 11, 12, 13 or 14 consecutive ribonucleotides at the 3' terminus are linked by 2'-5' internucleotide linkages In one preferred embodiment, four consecutive nucleotides at the 3' terminus of (N')y are joined by three 2'-5' phosphodiester bonds, wherein one or more of the 2'-5' nucleotides which form the 2'-5' phosphodiester bonds further comprises a 3'-O-methyl sugar modification. Preferably the 3' terminal nucleotide of (N')y comprises a 2'OMe sugar modification. In certain preferred embodiments of Structure C, x=y=19 and in (N')y two or more consecutive nucleotides at positions 15, 16, 17, 18 and 19 comprise a nucleotide joined to an adjacent nucleotide by a 2'-5' internucleotide bond. In various embodiments the nucleotide forming the 2'-5' internucleotide bond comprises a 3' deoxyribose nucleotide or a 3' methoxy nucleotide. In some embodiments the nucleotides at positions 17 and 18 in (N')y are joined by a 2'-5' internucleotide bond. In other embodiments the nucleotides at positions 16-17, 17-18, or 16-18 in (N')y are joined by a 2'-5' internucleotide bond.

In certain embodiments (N')y comprises an L-DNA at position 2 and 2'-5' internucleotide bonds at positions 16-17, 17-18, or 16-18. In certain embodiments (N')y comprises 2'-5' internucleotide bonds at positions 16-17, 17-18, or 16-18 and a 5' terminal cap nucleotide.

According to various embodiments of Structure (C), in (N')y 2, 3, 4, 5, 6, 7, 8, 9, 10, 11, 12, 13 or 14 consecutive nucleotides at either terminus or 2-8 modified nucleotides at each of the 5' and 3' termini are independently mirror nucleotides. In some embodiments the mirror nucleotide is an L-ribonucleotide. In other embodiments the mirror nucleotide is an L-deoxyribonucleotide. The mirror nucleotide may further be modified at the sugar or base moiety or in an internucleotide linkage.

In one preferred embodiment of Structure (C), the 3' terminal nucleotide or two or three consecutive nucleotides at the 3' terminus of (N')y are L-deoxyribonucleotides.

In other embodiments of Structure (C), in (N')y 2, 3, 4, 5, 6, 7, 8, 9, 10, 11, 12, 13 or 14 consecutive ribonucleotides at either terminus or 2-8 modified nucleotides at each of the 5' and 3' termini are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'OMe). In one series of preferred embodiments, three, four or five consecutive nucleotides at the 5' terminus of (N')y comprise the 2'OMe modification. In another preferred embodiment, three consecutive nucleotides at the 3' terminus of (N')y comprise the 2'OMe modification.

In some embodiments of Structure (C), in (N')y 2, 3, 4, 5, 6, 7, 8, 9, 10, 11, 12, 13 or 14 consecutive ribonucleotides at either or 2-8 modified nucleotides at each of the 5' and 3' termini are independently bicyclic nucleotides. In various embodiments the bicyclic nucleotide is a locked nucleic acid (LNA) or a species of LNA, e.g. 2'-O, 4'-C-ethylene-bridged nucleic acid (ENA) is a species of LNA.

In various embodiments (N')y comprises modified nucleotides at the 5' terminus or at both the 3' and 5' termini.

In some embodiments of Structure (C), at least two nucleotides at either or both the 5' and 3' termini of (N')y are joined by P-ethoxy backbone modifications. In certain preferred embodiments x=y=19 or x=y=23; in (N)x the nucleotides alternate between modified ribonucleotides and unmodified ribonucleotides, each modified ribonucleotide being modified so as to have a 2'OMe on its sugar and the ribonucleotide located at the middle position of (N)x being unmodified; and four consecutive nucleotides at the 3' terminus or at the 5' terminus of (N')y are joined by three P-ethoxy backbone modifications. In another preferred embodiment, three consecutive nucleotides at the 3' terminus or at the 5' terminus of (N')y are joined by two P-ethoxy backbone modifications.

In some embodiments of Structure (C), in (N')y 2, 3, 4, 5, 6, 7 or 8, consecutive ribonucleotides at each of the 5' and 3' termini are independently mirror nucleotides, nucleotides joined by 2'-5' phosphodiester bond, 2' sugar modified nucleotides or bicyclic nucleotide. In one embodiment, the modification at the 5' and 3' termini of (N')y is identical. In one preferred embodiment, four consecutive nucleotides at the 5' terminus of (N')y are joined by three 2'-5' phosphodiester bonds and three consecutive nucleotides at the 3' terminus of (N')y are joined by two 2'-5' phosphodiester bonds. In another embodiment, the modification at the 5' terminus of (N')y is different from the modification at the 3' terminus of (N')y. In one specific embodiment, the modified nucleotides at the 5' terminus of (N')y are mirror nucleotides and the modified nucleotides at the 3' terminus of (N')y are joined by 2'-5' phosphodiester bond. In another specific embodiment, three consecutive nucleotides at the 5' terminus of (N')y are LNA nucleotides and three consecutive nucleotides at the 3' terminus of (N')y are joined by two 2'-5' phosphodiester bonds. In (N)x the nucleotides alternate between modified ribonucleotides and unmodified ribonucleotides, each modified ribonucleotide being modified so as to have a 2'OMe on its sugar and the ribonucleotide located at the middle of (N)x being unmodified, or the ribonucleotides in (N)x being unmodified.

In another embodiment of Structure (C), the present invention provides a compound wherein x=y=19 or x=y=23; in (N)x the nucleotides alternate between modified ribonucleotides and unmodified ribonucleotides, each modified ribonucleotide being modified so as to have a 2'OMe on its sugar and the ribonucleotide located at the middle of (N)x being unmodified; three nucleotides at the 3' terminus of (N')y are joined by two 2'-5' phosphodiester bonds and three nucleotides at the 5' terminus of (N')y are LNA such as ENA.

In another embodiment of Structure (C), five consecutive nucleotides at the 5' terminus of (N')y comprise the 2'OMe sugar modification and two consecutive nucleotides at the 3' terminus of (N')y are L-DNA.

In yet another embodiment, the present invention provides a compound wherein x=y=19 or x=y=23; (N)x consists of unmodified ribonucleotides; three consecutive nucleotides at the 3' terminus of (N')y are joined by two 2'-5' phosphodiester bonds and three consecutive nucleotides at the 5' terminus of (N')y are LNA such as ENA.

According to other embodiments of Structure (C), in (N')y the 5' or 3' terminal nucleotide, or 2, 3, 4, 5 or 6 consecutive nucleotides at either termini or 1-4 modified nucleotides at each of the 5' and 3' termini are independently phosphonocarboxylate or phosphinocarboxylate nucleotides (PACE nucleotides). In some embodiments the PACE nucleotides are deoxyribonucleotides. In some preferred embodiments in (N')y, 1 or 2 consecutive nucleotides at each of the 5' and 3' termini are PACE nucleotides.

In additional embodiments, the present invention provides a compound having Structure (D): (D) 5' (N)x-Z 3' antisense strand 3' Z'—(N')y 5' sense strand wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is independently an integer between 18 and 40;

wherein (N)x comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of $(N')_y$ is a sequence substantially complementary to (N)x; and wherein the sequence of $(N)_x$ comprises an antisense sequence substantially complementary to about 18 to about 40 consecutive ribonucleotides in an mRNA set forth in any one of SEQ ID NOS:1-3. Preferably $(N)_x$ comprises an antisense sequence substantially identical to an antisense sequence set forth in any one of Tables A-H (SEQ ID NOS: 4-8,533).

In one embodiment of Structure (D), x=y=19 or x=y=23; (N)x comprises unmodified ribonucleotides in which two consecutive nucleotides linked by one 2'-5' internucleotide linkage at the 3' terminus; and (N')y comprises unmodified ribonucleotides in which two consecutive nucleotides are linked by one 2'-5' internucleotide linkage at the 5' terminus.

In some embodiments, x=y=19 or x=y=23; (N)x comprises unmodified ribonucleotides in which three consecutive nucleotides at the 3' terminus are joined together by two 2'-5' phosphodiester bonds; and (N')y comprises unmodified ribonucleotides in which four consecutive nucleotides at the 5' terminus are joined together by three 2'-5' phosphodiester bonds (set forth herein as Structure II).

According to various embodiments of Structure (D), 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are linked by 2'-5' internucleotide linkages.

According to one preferred embodiment of Structure (D), four consecutive nucleotides at the 5' terminus of (N')y are joined by three 2'-5' phosphodiester bonds and three consecutive nucleotides at the 3' terminus of (N')x are joined by two 2'-5' phosphodiester bonds. Three nucleotides at the 5' terminus of (N')y and two nucleotides at the 3' terminus of (N')x may also comprise 3'-O-methyl modifications.

According to various embodiments of Structure (D), 2, 3, 4, 5, 6, 7, 8, 9, 10, 11, 12, 13 or 14 consecutive nucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently mirror nucleotides. In some embodiments the mirror is an L-ribonucleotide. In other embodiments the mirror nucleotide is L-deoxyribonucleotide.

In other embodiments of Structure (D), 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently 2' sugar modified nucleotides. In some embodiments the 2' sugar modification comprises an amino, a fluoro, an alkoxy or an alkyl moiety. In certain embodiments the 2' sugar modification comprises a methoxy moiety (2'OMe).

In one preferred embodiment of Structure (D), five consecutive nucleotides at the 5' terminus of (N')y comprise the 2'OMe modification and five consecutive nucleotides at the 3' terminus of (N')x comprise the 2'OMe modification. In another preferred embodiment of Structure (D), ten consecutive nucleotides at the 5' terminus of (N')y comprise the 2'OMe modification and five consecutive nucleotides at the 3' terminus of (N')x comprise the 2'OMe modification. In another preferred embodiment of Structure (D), thirteen consecutive nucleotides at the 5' terminus of (N')y comprise the 2'OMe modification and five consecutive nucleotides at the 3' terminus of (N')x comprise the 2'OMe modification.

In some embodiments of Structure (D), 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (D), (N')y comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In various embodiments of Structure (D), (N)x comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In some embodiments wherein each of the 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In one specific embodiment of Structure (D), five consecutive nucleotides at the 5' terminus of (N')y comprise the 2'OMe modification and two consecutive nucleotides at the 3' terminus of (N')y are L-DNA. In addition, the compound may further comprise five consecutive 2'OMe modified nucleotides at the 3' terminus of (N')x.

In various embodiments of Structure (D), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (E): (E) 5' (N)x-Z 3' antisense strand 3' Z'—(N')y 5' sense strand wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is independently an integer between 18 and 40;

wherein (N)x comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of (N')$_y$ is a sequence substantially complementary to (N)x; and wherein the sequence of (N)$_x$ comprises an antisense sequence substantially complementary to about 18 to about 40 consecutive ribonucleotides in an mRNA set forth in any one of SEQ ID NOS:1-3. Preferably (N)$_x$ comprises an antisense sequence substantially identical to an antisense sequence set forth in any one of Tables A-H (SEQ ID NOS: 4-8,533).

In certain preferred embodiments the ultimate nucleotide at the 5' terminus of (N)x is unmodified.

According to various embodiments of Structure (E), 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are linked by 2'-5' internucleotide linkages.

According to various embodiments of Structure (E), 2, 3, 4, 5, 6, 7, 8, 9, 10, 11, 12, 13 or 14 consecutive nucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive nucleotides starting at the ultimate or penultimate position of the 3' terminus of (N')y are independently mirror nucleotides. In some embodiments the mirror is an L-ribonucleotide. In other embodiments the mirror nucleotide is L-deoxyribonucleotide.

In other embodiments of Structure (E), 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently 2' sugar modified nucleotides. In some embodiments the 2' sugar modification comprises an amino, a fluoro, an alkoxy or an alkyl moiety. In certain embodiments the 2' sugar modification comprises a methoxy moiety (2'OMe).

In some embodiments of Structure (E), 2, 3, 4, 5, 6, 7, 8, 9, 10, 11, 12, 13 or 14 consecutive ribonucleotides starting at the ultimate or penultimate position of the 5' terminus of (N)x, preferably stalling at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (E), (N')y comprises modified nucleotides selected from a bicyclic nucleotide, a 2' sugar modified nucleotide, a mirror nucleotide, an altritol nucleotide, a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In various embodiments of Structure (E), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where both 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (E), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (F): (F) 5' (N)x-Z 3' antisense strand 3' Z'—(N')y 5' sense strand wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is independently an integer between 18 and 40;

wherein each of (N)x and (N')y comprise unmodified ribonucleotides in which each of (N)x and (N')y independently comprise one modified nucleotide at the 3' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a PACE linkage or a nucleotide joined to an adjacent nucleotide by a 2'-5' phosphodiester bond;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of (N')y is a sequence substantially complementary to (N)x; and wherein the sequence of (N)$_x$ comprises an antisense sequence substantially complementary to about 18 to about 40 consecutive ribonucleotides in an mRNA set forth in any one of SEQ ID NOS:1-3. Preferably (N)$_x$ comprises an antisense sequence substantially identical to an antisense sequence set forth in any one of Tables A-H (SEQ ID NOS: 4-8,533).

In some embodiments of Structure (F), x=y=19 or x=y=23; (N')y comprises unmodified ribonucleotides in which two consecutive nucleotides at the 3' terminus comprise two consecutive mirror deoxyribonucleotides; and (N)x comprises unmodified ribonucleotides in which one nucleotide at the 3' terminus comprises a minor deoxyribonucleotide (set forth as Structure III).

According to various embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are linked by 2'-5' internucleotide linkages.

According to one preferred embodiment of Structure (F), three consecutive nucleotides at the 3' terminus of (N')y are joined by two 2'-5' phosphodiester bonds and three consecutive nucleotides at the 3' terminus of (N')x are joined by two 2'-5' phosphodiester bonds.

According to various embodiments of Structure (F), 2, 4, 5, 6, 7, 8, 9, 10, 11, 12, 13 or 14 consecutive nucleotides independently beginning at the ultimate or penultimate position of the 3' termini of (N)x and (N')y are independently minor nucleotides. In some embodiments the mirror nucleotide is an L-ribonucleotide. In other embodiments the mirror nucleotide is an L-deoxyribonucleotide.

In other embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently 2' sugar modified nucleotides. In some embodiments the 2' sugar modification comprises an amino, a fluoro, an alkoxy or an alkyl moiety. In certain embodiments the 2' sugar modification comprises a methoxy moiety (2'OMe).

In some embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (F), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at both the 3' and 5' termini.

In various embodiments of Structure (F), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (F), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (G): (G) 5' (N)x-Z 3' antisense strand 3' Z'—(N')y 5' sense strand wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is independently an integer between 18 and 40;

wherein each of (N)x and (N')y comprise unmodified ribonucleotides in which each of (N)x and (N')y independently comprise one modified nucleotide at the 5' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a PACE linkage or a nucleotide joined to an adjacent nucleotide by a 2'-5' phosphodiester bond;

wherein for (N)x the modified nucleotide is preferably at penultimate position of the 5' terminal;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of (N')$_y$ is a sequence substantially complementary to (N)x; and wherein the sequence of (N)$_x$ comprises an antisense sequence substantially complementary to about 18 to about 40 consecutive ribonucleotides in an mRNA set forth in any one of SEQ ID NOS:1-3. Preferably (N)$_x$ comprises an antisense sequence substantially identical to an antisense sequence set forth in any one of Tables A-H (SEQ ID NOS: 4-8,533).

In some embodiments of Structure (G), x=y=19 or x=y=23.

According to various embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are linked by 2'-5' internucleotide linkages. For (N)x the modified nucleotides preferably start at the penultimate position of the 5' terminal.

According to various embodiments of Structure (G), 2, 3, 4, 5, 6, 7, 8, 9, 10, 11, 12, 13 or 14 consecutive nucleotides independently beginning at the ultimate or penultimate position of the 5' termini of (N)x and (N')y are independently mirror nucleotides. In some embodiments the mirror nucleotide is an L-ribonucleotide. In other embodiments the mirror nucleotide is an L-deoxyribonucleotide. For (N)x the modified nucleotides preferably start at the penultimate position of the 5' terminal.

In other embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are independently 2' sugar modified nucleotides. In some embodiments the 2' sugar modification comprises an amino, a fluoro, an alkoxy or an alkyl moiety. In certain embodiments the 2' sugar modification comprises a methoxy moiety (2'OMe). In some preferred embodiments the consecutive modified nucleotides preferably begin at the penultimate position of the 5' terminus of (N)x.

In one preferred embodiment of Structure (G), five consecutive ribonucleotides at the 5' terminus of (N')y comprise a 2'OMe modification and one ribonucleotide at the 5' penultimate position of (N')x comprises a 2'OMe modification. In another preferred embodiment of Structure (G), five consecutive ribonucleotides at the 5' terminus of (N')y comprise a 2'OMe modification and two consecutive ribonucleotides at the 5' terminal position of (N')x comprise a 2'OMe modification.

In some embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are bicyclic nucleotides. In various embodiments the bicyclic nucleotide is a locked nucleic acid (LNA) such as a 2'-O, 4'-C-ethylene-bridged nucleic acid (ENA). In some preferred embodiments the consecutive modified nucleotides preferably begin at the penultimate position of the 5' terminus of (N)x.

In various embodiments of Structure (G), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In various embodiments of Structure (G), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond. In various embodiments of Structure (G), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (H): (H) 5' (N)x-Z 3' antisense strand 3' Z'—(N)y 5' sense strand wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is independently an integer between 18 and 40;

wherein (N)x comprises unmodified ribonucleotides further comprising one modified nucleotide at the 3' terminal or penultimate position or the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at an internal position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of (N')y is a sequence substantially complementary to (N)x; and wherein the sequence of (N)x comprises an antisense sequence substantially complementary to about 18 to about 40 consecutive ribonucleotides in an mRNA set forth in any one of SEQ ID NOS:1-3. Preferably (N)x comprises an antisense sequence substantially identical to an antisense sequence set forth in any one of Tables A-H (SEQ ID NOS: 4-8,533).

In one embodiment of Structure (H), 2, 3, 4, 5, 6, 7, 8, 9, 10, 11, 12, 13 or 14 consecutive ribonucleotides independently beginning at the ultimate or penultimate position of the 3' terminus or the 5' terminus or both termini of (N)x are independently 2' sugar modified nucleotides, bicyclic nucleotides, mirror nucleotides, altritol nucleotides or nucleotides joined to an adjacent nucleotide by a 2'-5' phosphodiester bond and 2, 3, 4, 5, 6, 7, 8, 9, 10, 11, 12, 13 or 14 consecutive internal ribonucleotides in (N')y are independently 2' sugar modified nucleotides, bicyclic nucleotides, mirror nucleotides, altritol nucleotides or nucleotides joined to an adjacent nucleotide by a 2'-5' phosphodiester bond. In some embodiments the 2' sugar modification comprises an amino, a fluoro, an alkoxy or an alkyl moiety. In certain embodiments the 2' sugar modification comprises a methoxy moiety (2'OMe).

In another embodiment of Structure (H), 2, 3, 4, 5, 6, 7, 8, 9, 10, 11, 12, 13 or 14 consecutive ribonucleotides independently beginning at the ultimate or penultimate position of the 3' terminus or the 5' terminus or 2-8 consecutive nucleotides at each of 5' and 3' termini of (N')y are independently 2' sugar modified nucleotides, bicyclic nucleotides, mirror nucleotides, altritol nucleotides or nucleotides joined to an adjacent nucleotide by a 2'-5' phosphodiester bond, and 2, 3, 4, 5, 6, 7, 8, 9, 10, 11, 12, 13 or 14 consecutive internal ribonucleotides in (N)x are independently 2' sugar modified nucleotides, bicyclic nucleotides, mirror nucleotides, altritol nucleotides or nucleotides joined to an adjacent nucleotide by a phosphodiester bond.

In one embodiment wherein each of 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (H), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In one preferred embodiment of Structure (H), x=y=19; three consecutive ribonucleotides at the 9-11 nucleotide positions of (N')y comprise 2'OMe modification and five consecutive ribonucleotides at the 3' terminal position of (N')x comprise 2'OMe modification.

For all the above Structures (A)-(H), in various embodiments x=y and each of x and y is and integer selected from the group consisting of 19, 20, 21, 22 and 23. In certain embodiments, x=y=19. In other embodiments x=y=21. In additional embodiments the compounds of the invention comprise modified ribonucleotides in alternating positions wherein each N at the 5' and 3' termini of (N)x is modified in its sugar residue and the middle ribonucleotide is not modified, e.g. ribonucleotide in position 10 in a 19-mer strand, position 11 in a 21-mer and position 12 in a 23-mer strand.

In some embodiments where x=y=21 or x=y=23 the position of modifications in the 19-mer are adjusted for a 21- or 23-mer oligonucleotide with the proviso that the middle nucleotide of the antisense strand is preferably not modified.

In some embodiments, neither (N)x nor (N')y are phosphorylated at the 3' and 5' termini. In other embodiments either or both (N)x and (N')y are phosphorylated at the 3' termini. In yet another embodiment, either or both (N)x and (N')y are phosphorylated at the 3' termini using non-cleavable phosphate groups. In yet another embodiment, either or both (N)x and (N')y are phosphorylated at the terminal 5' termini position using cleavable or non-cleavable phosphate groups. In some embodiments the siRNA compounds are blunt ended and are non-phosphorylated at the termini; however, comparative experiments have shown that siRNA compounds phosphorylated at one or both of the 3'-termini have similar activity in vivo compared to the non-phosphorylated compounds.

In certain embodiments for all the above-mentioned Structures, the siRNA compound is blunt ended, for example wherein both Z and Z' are absent. In an alternative embodiment, the compound comprises at least one 3' overhang, wherein at least one of Z or Z' is present. Z and Z' independently comprises one or more covalently linked modified or non-modified nucleotides, for example inverted dT or dA; dT, LNA, mirror nucleotide and the like. In some embodiments each of Z and Z' are independently selected from dT and dTdT. siRNA in which Z and/or Z' is present have similar activity and stability as siRNA in which Z and Z' are absent.

In certain embodiments for all the above-mentioned Structures, the siRNA compound comprises one or more phosphonocarboxylate and/or phosphinocarboxylate nucleotides (PACE nucleotides). In some embodiments the PACE nucleotides are deoxyribonucleotides and the phosphinocarboxylate nucleotides are phosphinoacetate nucleotides.

In certain embodiments for all the above-mentioned Structures, the siRNA compound comprises one or inure locked nucleic acids (LNA) also defined as bridged nucleic acids or bicyclic nucleotides. Preferred locked nucleic acids are 2'-O, 4'-C-ethylene nucleosides (ENA) or 2'-O, 4'C-methylene nucleosides. Other examples of LNA and ENA nucleotides are disclosed in WO 98/39352, WO 00/47599 and WO 99/14226, all incorporated herein by reference.

In certain embodiments for all the above-mentioned Structures, the compound comprises one or more altritol monomers (nucleotides), also defined as 1,5 anhydro-2-deoxy-D-altrito-hexitol (see for example, Allart, et al., 1998. Nucleosides & Nucleotides 17:1523-1526; Herdewijn et al., 1999. Nucleosides & Nucleotides 18:1371-1376; Fisher et al., 2007, NAR 35(4):1064-1074; all incorporated herein by reference).

The present invention explicitly excludes compounds in which each of N and/or N' is a deoxyribonucleotide (D-A, D-C, D-G, D-T). In certain embodiments (N)x and (N')y may comprise independently 1, 2, 3, 4, 5, 6, 7, 8, 9 or more deoxyribonucleotides. In certain embodiments the present invention provides a compound wherein each of N is an unmodified ribonucleotide and the 3' terminal nucleotide or 2, 3, 4, 5, 6, 7, 8, 9, 10, 11, 12, 13 or 14 consecutive nucleotides at the 3' terminus of (N')y are deoxyribonucleotides. In yet other embodiments each of N is an unmodified ribonucleotide and the 5' terminal nucleotide or 2, 3, 4, 5, 6, 7, 8, 9, 10, 11, 12, 13 or 14 consecutive nucleotides at the 5' terminus of (N')y are deoxyribonucleotides. In further embodiments the 5' terminal nucleotide or 2, 3, 4, 5, 6, 7, 8, or 9 consecutive nucleotides at the 5' terminus and 1, 2, 3, 4, 5, or 6 consecutive nucleotides at the 3' termini of (N)x are deoxyribonucleotides and each of N' is an unmodified ribonucleotide. In yet further embodiments (N)x comprises unmodified ribonucleotides and 1 or 2, 3 or 4 consecutive deoxyribonucleotides independently at each of the 5' and 3' termini and 1 or 2, 3, 4, 5 or 6 consecutive deoxyribonucleotides in internal positions; and each of N' is an unmodified ribonucleotide, In certain embodiments the 3' terminal nucleotide or 2, 3, 4, 5, 6, 7, 8, 9, 10, 11, 12 13 or 14 consecutive nucleotides at the 3' terminus of (N')y and the terminal 5' nucleotide or 2, 3, 4, 5, 6, 7, 8, 9, 10, 11, 12, 13 or 14 consecutive nucleotides at the 5' terminus of (N)x are deoxyribonucleotides. The present invention excludes compounds in which each of N and/or N' is a deoxyribonucleotide. In some embodiments the 5' terminal nucleotide of N or 2 or 3 consecutive of N and 1, 2, or 3 of N' is a deoxyribonucleotide. Certain examples of active DNA/RNA siRNA chimeras are disclosed in US patent publication 2005/0004064, and Ui-Tei, 2008 (NAR 36(7):2136-2151) incorporated herein by reference in their entirety.

Unless otherwise indicated, in preferred embodiments of the structures discussed herein the covalent bond between each consecutive N and N' is a phosphodiester bond.

An additional novel molecule provided by the present invention is an oligonucleotide comprising consecutive nucleotides wherein a first segment of such nucleotides encode a first inhibitory RNA molecule, a second segment of such nucleotides encode a second inhibitory RNA molecule, and a third segment of such nucleotides encode a third inhibitory RNA molecule. Each of the first, the second and the third segment may comprise one strand of a double stranded RNA and the first, second and third segments may be joined together by a linker. Further, the oligonucleotide may comprise three double stranded segments joined together by one or more linker.

Thus, one molecule provided by the present invention is an oligonucleotide comprising consecutive nucleotides which encode three inhibitory RNA molecules; said oligonucleotide may possess a triple stranded structure, such that three double stranded arms are linked together by one or more linker, such as any of the linkers presented hereinabove. This molecule forms a "star"-like structure, and may also be referred to herein as RNAstar. Such structures are disclosed in PCT patent publication WO 2007/091269, assigned to the assignee of the present invention and incorporated herein in its entirety by reference.

A covalent bond refers to an internucleotide linkage linking one nucleotide monomer to an adjacent nucleotide monomer. A covalent bond includes for example, a phosphodiester bond, a phosphorothioate bond, a P-alkoxy bond, a P-carboxy bond and the like. The normal internucleoside linkage of RNA and DNA is a 3' to 5' phosphodiester linkage. In certain preferred embodiments a covalent bond is a phosphodiester bond. Covalent bond encompasses non-phosphorus-containing internucleoside linkages, such as those disclosed in WO 2004/041924 inter alia. Unless otherwise indicated, in preferred embodiments of the structures discussed herein the covalent bond between each consecutive N and N' is a phosphodiester bond.

For all of the structures above, in some embodiments the oligonucleotide sequence of (N)x is fully complementary to the oligonucleotide sequence of (N')y. In other embodiments (N)x and (N')y are substantially complementary. In certain embodiments (N)x is fully complementary to a target sequence. In other embodiments (N)x is substantially complementary to a target sequence.

In some embodiments, neither (N)x nor (N')y are phosphorylated at the 3' and 5' termini. In other embodiments either or both (N)x and (N')y are phosphorylated at the 3' termini (3' Pi). In yet another embodiment, either or both (N)x and (N')y are phosphorylated at the 3' termini with non-cleavable phosphate groups. In yet another embodiment, either or both (N)x and (N')y are phosphorylated at the terminal 2' termini position using cleavable or non-cleavable phosphate groups. Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks.

In one aspect the present invention provides a compound having Structure (I):

(I) 5' (N)x-Z 3' (antisense strand)
3' Z'—(N')y-z" 5' (sense strand)

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein z" may be present or absent, but if present is a capping moiety covalently attached at the 5' terminus of (N')y;

wherein x=18 to 27;
wherein y=18 to 27;

wherein (N)x comprises modified and unmodified ribonucleotides, each modified ribonucleotide having a 2'OMe on its sugar, wherein N at the 3' terminus of (N)x is a modified ribonucleotide, (N)x comprises at least five alternating modified ribonucleotides beginning at the 3' end and at least nine modified ribonucleotides in total and each remaining N is an unmodified ribonucleotide;

wherein in (N')y at least one unconventional moiety is present, which unconventional moiety may be an abasic ribose moiety, an abasic deoxyribose moiety, a modified or unmodified deoxyribonucleotide, a mirror nucleotide, and a nucleotide joined to an adjacent nucleotide by a 2'-5' internucleotide phosphate bond; and wherein the sequence of (N')y is a sequence substantially complementary to (N)x; and wherein the sequence of (N)x comprises an antisense sequence substantially complementary to 18 to 27 consecutive ribonucleotides in an mRNA set forth in any one of SEQ ID NOS:1-3. Preferably (N)x comprises an antisense sequence substantially identical to an antisense sequence set forth in any one of Tables A-H (SEQ ID NOS: 4-8,533). In some embodiments x=y=19. In other embodiments x=y=21. In some embodiments the at least one unconventional moiety is present at positions 15, 16, 17, or 18 in (N')y. In some embodiments the unconventional moiety is selected from a mirror nucleotide, an abasic ribose moiety and an abasic deoxyribose moiety. In some preferred embodiments the unconventional moiety is a mirror nucleotide, preferably an L-DNA moiety. In some embodiments The compound comprises an L-DNA moiety at position 17, position 18 or positions 17 and 18.

In other embodiments the unconventional moiety is an abasic moiety. In various embodiments (N')y comprises at least five abasic ribose moieties or abasic deoxyribose moieties.

In yet other embodiments (N')y comprises at least five abasic ribose moieties or abasic deoxyribose moieties and at least one of N' is an LNA.

In some embodiments (N)x comprises nine alternating modified ribonucleotides. In other embodiments of Structure (I) (N)x comprises nine alternating modified ribonucleotides further comprising a 2'O modified nucleotide at position 2. In some embodiments (N)x comprises 2'OMe modified ribonucleotides at the odd numbered positions 1, 3, 5, 7, 9, 11, 13, 15, 17, 19. In other embodiments (N)x further comprises a 2'OMe modified ribonucleotide at one or both of positions 2 and 18. In yet other embodiments (N)x comprises 2'OMe modified ribonucleotides at positions 2, 4, 6, 8, 11, 13, 15, 17, 19.

hi various embodiments z" is present and is selected from an abasic ribose moiety, a deoxyribose moiety; an inverted abasic ribose moiety, a deoxyribose moiety; C6-amino-Pi; a mirror nucleotide.

In another aspect the present invention provides a compound having Structure (J) set forth below:

(J) 5' (N)x-Z 3' (antisense strand)
3' Z'—(N')y-z" 5' (sense strand)

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein z" may be present or absent but if present is a capping moiety covalently attached at the 5' terminus of (N')y;

wherein x=18 to 27;
wherein y=18 to 27;

wherein (N)x comprises modified or unmodified ribonucleotides, and optionally at least one unconventional moiety;

wherein in (N')y at least one unconventional moiety is present, which unconventional moiety may be an abasic ribose moiety, an abasic deoxyribose moiety, a modified or unmodified deoxyribonucleotide, a mirror nucleotide, a non-base pairing nucleotide analog or a nucleotide joined to an adjacent nucleotide by a 2'-5' internucleotide phosphate bond; and wherein the sequence of (N')y is a sequence substantially complementary to (N)x; and wherein the sequence of (N)x comprises an antisense sequence substantially complementary to 18 to 27 consecutive ribonucleotides in an mRNA set forth in any one of SEQ ID NOS:1-3. Preferably (N)x comprises an antisense sequence substantially identical to an antisense sequence set forth in any one of Tables A-H (SEQ ID NOS: 4-8,533).

In some embodiments x=y=19. In other embodiments x=y=21. In some preferred embodiments (N)x comprises modified and unmodified ribonucleotides, and at least one unconventional moiety.

In some embodiments in (N)x the N at the 3' terminus is a modified ribonucleotide and (N)x comprises at least 8 modified ribonucleotides. In other embodiments at least 5 of the at least 8 modified ribonucleotides are alternating beginning at the 3' end. In some embodiments (N)x comprises an abasic moiety in one of positions 5, 6, 7, 8, 9, 10, 11, 12, 13, 14 or 15.

In some embodiments the at least one unconventional moiety in (N')y is present at positions 15, 16, 17, or 18. In some embodiments the unconventional moiety is selected from a mirror nucleotide, an abasic ribose moiety and an abasic deoxyribose moiety. In some preferred embodiments the unconventional moiety is a mirror nucleotide, preferably an L-DNA moiety. In some embodiments an L-DNA moiety is present at position 17, position 18 or positions 17 and 18. In other embodiments the at least one unconventional moiety in (N')y is an abasic ribose moiety or an abasic deoxyribose moiety.

In yet another aspect the present invention provides a compound having Structure (K) set forth below:

(K) 5' (N)x—Z 3' (antisense strand)
3' Z'—(N')y-z" 5' (sense strand)

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein z" may be present or absent but if present is a capping moiety covalently attached at the 5' terminus of (N')y;

wherein x=18 to 27; wherein y=18 to 27;

wherein (N)x comprises a combination of modified or unmodified ribonucleotides and unconventional moieties, any modified ribonucleotide having a 2'OMe on its sugar;

wherein (N')y comprises modified or unmodified ribonucleotides and optionally an unconventional moiety, any modified ribonucleotide having a 2'OMe on its sugar;

wherein the sequence of (N')y is a sequence substantially complementary to (N)x; and wherein the sequence of (N)x comprises an antisense sequence substantially complementary to 18 to 27 consecutive ribonucleotides in an mRNA set forth in any one of SEQ ID NOS:1-3. Preferably (N)x comprises an antisense sequence substantially identical to an antisense sequence set forth in any one of Tables A-H (SEQ ID NOS: 4-8,533).

In some embodiments x=y=19. In other embodiments x=y=21. In some preferred embodiments the at least one preferred one unconventional moiety is present in (N)x and is an abasic ribose moiety or an abasic deoxyribose moiety. In other embodiments the at least one unconventional moiety is present in (N)x and is a non-base pairing nucleotide analog. In various embodiments (N')y comprises unmodified ribonucleotides. In some embodiments (N)x comprises at least five abasic ribose moieties or abasic deoxyribose moieties or a combination thereof. In certain embodiments (N)x and/or (N')y comprise modified ribonucleotides which do not base pair with corresponding modified or unmodified ribonucleotides in (N')y and/or (N)x.

In various embodiments the present invention provides an siRNA set forth in Structure (L):

(L) 5' (N)x—Z 3' (antisense strand)
3' Z'—(N')y 5' (sense strand)

wherein each of N and N' is a nucleotide selected from an unmodified ribonucleotide, a modified ribonucleotide, an unmodified deoxyribonucleotide and a modified deoxyribonucleotide;

wherein each of $(N)_x$ and $(N')_y$ is an oligonucleotide in which each consecutive N or N' is joined to the next N or N' by a covalent bond;

wherein Z and Z' are absent;
wherein x=y=19;

wherein in (N')y the nucleotide in at least one of positions 15, 16, 17, 18 and 19 comprises a nucleotide selected from an abasic unconventional moiety, a mirror nucleotide, a deoxyribonucleotide and a nucleotide joined to an adjacent nucleotide by a 2'-5' internucleotide bond;

wherein (N)x comprises alternating modified ribonucleotides and unmodified ribonucleotides each modified ribonucleotide being modified so as to have a 2'OMe on its sugar and the ribonucleotide located at the middle position of (N)x being modified or unmodified, preferably unmodified; and wherein the sequence of (N')y is a sequence substantially complementary to (N)x; and wherein the sequence of (N)x comprises an antisense sequence substantially complementary to 18 to 27 consecutive ribonucleotides in an mRNA set forth in any one of SEQ ID NOS:1-3. Preferably (N)x comprises an antisense sequence substantially identical to an antisense sequence set forth in any one of Tables A-H (SEQ ID NOS: 4-8,533).

In some embodiments of Structure (L), in (N')y the nucleotide in one or both of positions 17 and 18 comprises a modified nucleotide selected from an abasic unconventional moiety, a mirror nucleotide and a nucleotide joined to an adjacent nucleotide by a 2'-5' internucleotide bond. In some embodiments the mirror nucleotide is selected from L-DNA and L-RNA. In various embodiments the mirror nucleotide is L-DNA.

In various embodiments (N')y comprises a modified nucleotide at position 15 wherein the modified nucleotide is selected from a mirror nucleotide and a deoxyribonucleotide.

In certain embodiments (N')y further comprises a modified nucleotide or pseudo nucleotide at position 2 wherein the pseudo nucleotide may be an abasic unconventional moiety and the modified nucleotide is optionally a mirror nucleotide.

In various embodiments the antisense strand (N)x comprises 2'O-Me modified ribonucleotides at the odd numbered positions (5' to 3'; positions 1, 3, 5, 7, 9, 11, 13, 15, 17, 19). In some embodiments (N)x further comprises 2'O-Me modified ribonucleotides at one or both positions 2 and 18. In other embodiments (N)x comprises 2'OMe modified ribonucleotides at positions 2, 4, 6, 8, 11, 13, 15, 17, 19.

Other embodiments of Structures (L) are envisaged wherein x=y=21; in these embodiments the modifications for (N')y discussed above instead of being in positions 17 and 18 are in positions 19 and 20 for 21-mer oligonucleotide; similarly the modifications in positions 15, 16, 17, 18 or 19 are in positions 17, 18, 19, 20 or 21 for the 21-mer oligonucleotide. The 2'OMe modifications on the antisense strand are similarly adjusted. In some embodiments (N)x comprises 2'OMe modified ribonucleotides at the odd numbered positions (5' to 3'; positions 1, 3, 5, 7, 9, 12, 14, 16, 18, 20 for the 21 mer oligonucleotide [nucleotide at position 11 unmodified]. In other embodiments (N)x comprises 2'OMe modified ribonucleotides at positions 2, 4, 6, 8, 10, 12, 14, 16, 18, 20 [nucleotide at position 11 unmodified for the 21 mer oligonucleotide.

In some embodiments (N')y further comprises a 5' terminal cap nucleotide. In various embodiments the terminal cap moiety is selected from an abasic unconventional moiety, an inverted abasic unconventional moiety, an L-DNA nucleotide, and a C6-imine phosphate (C6 amino linker with phosphate at terminus).

In other embodiments the present invention provides a double stranded compound having Structure (N) set forth below:

(N) 5' $(N)_x$—Z 3' (antisense strand)
3' Z'—$(N')_y$ 5' (sense strand)
wherein each of N and N' is a nucleotide selected from an unmodified ribonucleotide, a modified ribonucleotide, an unmodified deoxyribonucleotide and a modified deoxyribonucleotide;

wherein each of $(N)_x$ and $(N')_y$ is an oligonucleotide in which each consecutive N or N' is joined to the next N or N' by a covalent bond;

wherein Z and Z' are absent;

wherein each of x and y is independently an integer between 18 and 40;

wherein (N)x, (N')y or (N)x and (N')y comprise non base-pairing modified nucleotides such that (N)x and (N')y form less than 15 base pairs in the double stranded compound; and wherein the sequence of (N')y is a sequence substantially complementary to (N)x; and wherein the sequence of (N)x comprises an antisense sequence substantially complementary to 18 to 40 consecutive ribonucleotides in an mRNA set forth in any one of SEQ ID NOS:1-3. Preferably (N)x comprises an antisense sequence substantially identical to an antisense sequence set forth in any one of Tables A-H (SEQ ID NOS: 4-8,533).

In other embodiments the present invention provides a compound having Structure (O) set forth below:

(O) 5' $(N)_x$—Z 3' (antisense strand)
3' Z'—$(N')_y$ 5' (sense strand)
wherein each of N is a nucleotide selected from an unmodified ribonucleotide, a modified ribonucleotide, an unmodified deoxyribonucleotide and a modified deoxyribonucleotide;

wherein each of N' is a nucleotide analog selected from a six membered sugar nucleotide, seven membered sugar nucleotide, morpholino moiety, peptide nucleic acid and combinations thereof;

wherein each of $(N)_x$ and $(N')_y$ is an oligonucleotide in which each consecutive N or N' is joined to the next N or N' by a covalent bond;

wherein Z and Z' are absent;

wherein each of x and y is independently an integer between 18 and 40;

wherein the sequence of (N')y is a sequence substantially complementary to (N)x; and wherein the sequence of (N)x comprises an antisense sequence substantially complementary to 18 to 27 consecutive ribonucleotides in an mRNA set forth in any one of SEQ ID NOS:1-3. Preferably (N)x comprises an antisense sequence substantially identical to an antisense sequence set forth in any one of Tables A-H (SEQ ID NOS: 4-8,533). In other embodiments the present invention provides a compound having Structure (P) set forth below:

(P) 5' $(N)_x$—Z 3' (antisense strand)
3' Z'—$(N')_y$ 5' (sense strand)
wherein each of N and N' is a nucleotide selected from an unmodified ribonucleotide, a modified ribonucleotide, an unmodified deoxyribonucleotide and a modified deoxyribonucleotide;

wherein each of $(N)_x$ and $(N')_y$ is an oligonucleotide in which each consecutive N or N' is joined to the next N or N' by a covalent bond;

wherein Z and Z' are absent;

wherein each of x and y is independently an integer between 18 and 40;

wherein one of N or N' in an internal position of (N)x or (N')y or one or more of N or N' at a terminal position of (N)x or (N')y comprises an abasic moiety or a 2' modified nucleotide;

wherein the sequence of (N')y is a sequence substantially complementary to (N)x; and wherein the sequence of (N)x comprises an antisense sequence substantially complementary to 18 to 27 consecutive ribonucleotides in an mRNA set forth in any one of SEQ ID NOS:1-3. Preferably (N)x comprises an antisense sequence substantially identical to an antisense sequence set forth in any one of Tables A-H (SEQ ID NOS: 4-8,533). In various embodiments (N')y comprises a modified nucleotide at position 15 wherein the modified nucleotide is selected from a mirror nucleotide and a deoxyribonucleotide.

In certain embodiments (N')y further comprises a modified nucleotide at position 2 wherein the modified nucleotide is selected from a mirror nucleotide and an abasic unconventional moiety.

In various embodiments the antisense strand (N)x comprises 2'O-Me modified ribonucleotides at the odd numbered positions (5' to 3'; positions 1, 3, 5, 7, 9, 11, 13, 15, 17, 19). In some embodiments $(N)_x$ further comprises 2'O-Me modified ribonucleotides at one or both positions 2 and 18. In other embodiments (N)x comprises 2'OMe modified ribonucleotides at positions 2, 4, 6, 8, 11, 13, 15, 17, 19.

An additional novel molecule provided by the present invention is an oligonucleotide comprising consecutive nucleotides wherein a first segment of such nucleotides encode a first inhibitory RNA molecule, a second segment of such nucleotides encode a second inhibitory RNA molecule, and a third segment of such nucleotides encode a third inhibitory RNA molecule. Each of the first, the second and the third segment may comprise one strand of a double stranded RNA and the first, second and third segments may be joined together by a linker. Further, the oligonucleotide may comprise three double stranded segments joined together by one or more linker.

Thus, one molecule provided by the present invention is an oligonucleotide comprising consecutive nucleotides which encode three inhibitory RNA molecules; said oligonucleotide may possess a triple stranded structure, such that three double stranded arms are linked together by one or more linker, such as any of the linkers presented hereinabove. This molecule forms a "star"-like structure, and may also be referred to herein as RNAstar.

Said triple-stranded oligonucleotide may be an oligoribonucleotide having the general structure:

| 5' | Oligo1 (sense) | LINKER A | Oligo2 (sense) | 3' |
|---|---|---|---|---|
| 3' | Oligo1 (antisense) | LINKER B | Oligo3 (sense) | 5' |
| 3' | Oligo3 (antisense) | LINKER C | Oligo2 (antisense) | 5' |
| or | | | | |
| 5' | Oligo1 (sense) | LINKER A | Oligo2 (antisense) | 3' |
| 3' | Oligo1 (antisense) | LINKER B | Oligo3 (sense) | 5' |
| 3' | Oligo3 (antisense) | LINKER C | Oligo2 (sense) | 5' |
| or | | | | |
| 5' | Oligo1 (sense) | LINKER A | Oligo3 (antisense) | 3' |
| 3' | Oligo1 (antisense) | LINKER B | Oligo2 (sense) | 5' |
| 5' | Oligo3 (sense) | LINKER C | Oligo2 (antisense) | 3' | wherein one or more of linker A, linker B or linker C is present; any combination of two or more oligonucleotides and one or more of linkers A-C is possible, so long as the polarity of the strands and the general structure of the molecule remains. Further, if two or more of linkers A-C are present, they may be identical or different.

Thus, a triple-armed structure is formed, wherein each arm comprises a sense strand and complementary antisense strand (i.e. Oligo1 antisense base pairs to Oligo1 sense etc.). The triple armed structure may be triple stranded, whereby each arm possesses base pairing.

Further, the above triple stranded structure may have a gap instead of a linker in one or more of the strands. Such a molecule with one gap is technically quadruple stranded and not triple stranded; inserting additional gaps or nicks will lead to the molecule having additional strands. Preliminary results obtained by the inventors of the present invention indicate that said gapped molecules are more active in inhibiting certain target genes than the similar but non-gapped molecules. This may also be the case for nicked molecules.

According to one preferred embodiment of the invention, the antisense and the sense strands of the siRNA are phosphorylated only at the 3'-terminus and not at the 5'-terminus. According to another preferred embodiment of the invention, the antisense and the sense strands are non-phosphorylated. According to yet another preferred embodiment of the invention, the 5' most ribonucleotide in the sense strand is modified to abolish any possibility of in vivo 5'-phosphorylation.

Any siRNA sequence disclosed herein can be prepared having any of the modifications/structures disclosed herein. The combination of sequence plus structure is novel and can be used in the treatment of the conditions disclosed herein.

Lists of preferred siRNA are provided in Tables A-H infra. The separate lists of 19-mer, 21-mer and 23-mer siRNAs are prioritized based on their score according to a proprietary algorithm as the best sequences for targeting the human gene expression. Methods, molecules and compositions, which inhibit target genes are discussed herein at length, and any of said molecules and/or compositions are beneficially employed in the treatment of a patient suffering from any of said conditions. Tables A, C, F1, G and H set forth 19-mer oligomers. Tables B, D and F2, set forth 21-mer oligomers. Tables E1, E2, F3 and F4, set forth 23-mer oligomers.

DEFINITIONS

For convenience certain terms employed in the specification, examples and claims are described herein.

It is to be noted that, as used herein, the singular forms "a", "an" and "the" include plural forms unless the content clearly dictates otherwise.

Where aspects or embodiments of the invention are described in terms of Markush groups or other grouping of alternatives, those skilled in the art will recognize that the invention is also thereby described in terms of any individual member or subgroup of members of the group.

An "inhibitor" is a compound which is capable of reducing the expression of a gene or the activity of the product of such gene to an extent sufficient to achieve a desired biological or physiological effect. The term "inhibitor" as used herein refers to one or more of an oligonucleotide inhibitor, including siRNA, shRNA, miRNA and ribozymes. Inhibition may also be referred to as down-regulation or, for RNAi, silencing.

The term "inhibit" as used herein refers to reducing or down-regulating the expression of a gene or the activity of the product of such gene to an extent sufficient to achieve a desired biological or physiological effect. Inhibition may be complete or partial.

"Nucleotide" is meant to encompass deoxyribonucleotides and ribonucleotides, which may be natural or synthetic, and be modified or unmodified. Modifications include changes and substitutions to the sugar moiety, the base moiety and/or the internucleotide linkages.

As used herein, the terms "polynucleotide" and "nucleic acid" may be used interchangeably and refer to nucleotide sequences comprising deoxyribonucleic acid (DNA), and ribonucleic acid (RNA). The terms should also be understood to include, as equivalents, analogs of either RNA or DNA made from nucleotide analogs. Throughout this application mRNA sequences are set forth as representing the target of their corresponding genes. The terms "mRNA polynucleotide sequence" and mRNA are used interchangeably.

"Oligonucleotide" or "oligomer" refers to a deoxyribonucleotide or ribonucleotide sequence from about 2 to about 50 nucleotides. Each DNA or RNA nucleotide is independently natural or synthetic, and/or modified or unmodified. Modified nucleotide includes inter alia a mirror nucleotide (such as L-DNA or L-RNA). Modifications include changes to the sugar moiety, the base moiety and or the linkages between nucleotides in the oligonucleotide. The compounds of the present invention encompass molecules comprising deoxyribonucleotides, ribonucleotides, modified deoxyribonucleotides, modified ribonucleotides and combinations thereof.

As used herein, the terms "non-pairing nucleotide analog" means a nucleotide analog which comprises a non-base pairing moiety including but not limited to: 6 des amino adenosine (Nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide.

The present invention provides methods and compositions for inhibiting expression of a target gene in vivo. In general, the method includes administering oligoribonucleotides, in particular small interfering RNAs (i.e., siRNAs) or a nucleic acid material that can produce siRNA in a cell to target an mRNA; in an amount sufficient to down-regulate expression of the Nrf2 target gene by an RNA interference mechanism. In particular, the method is useful for inhibiting expression of the Nrf2 gene for treatment of a subject suffering from a disease related to expression of that gene. In accordance with the present invention, the siRNA molecules or inhibitors of the target gene are used as drugs to treat various pathologies.

All analogs of, or modifications to, a nucleotide/oligonucleotide may be employed with the present invention, provided that said analog or modification does not substantially adversely affect the function of the nucleotide/oligonucleotide. Acceptable modifications include modifications of the sugar moiety, modifications of the base moiety, modifications in the internucleotide linkages and combinations thereof.

What is sometimes referred to in the present invention as an "abasic nucleotide" or "abasic nucleotide analog" is more properly referred to as a pseudo-nucleotide or an unconventional moiety. A nucleotide is a monomeric unit of nucleic acid, consisting of a ribose or deoxyribose sugar, a phosphate, and a base (adenine, guanine, thymine, or cytosine in DNA; adenine, guanine, uracil, or cytosine in RNA). A modified nucleotide comprises a modification in one or more of the sugar, phosphate and or base. The abasic pseudo-nucleotide lacks a base, and thus is not strictly a nucleotide.

The term "capping moiety" as used herein includes abasic ribose moiety, abasic deoxyribose moiety, modifications abasic ribose and abasic deoxyribose moieties including 2' O alkyl modifications; inverted abasic ribose and abasic deoxyribose moieties and modifications thereof; C6-imino-Pi; a mirror nucleotide including L-DNA and L-RNA; 5'OMe nucleotide; and nucleotide analogs including 4',5'-methylene nucleotide; 1-(β-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

Certain preferred capping moieties are abasic ribose or abasic deoxyribose moieties; inverted abasic ribose or abasic deoxyribose moieties; C6-amino-Pi; a minor nucleotide including L-DNA and L-RNA. Figure 22 shows the chemical structure of a C6-amino phosphate 5' capping moiety and its attachment point to the 5' terminal (N').

The term "unconventional moiety" as used herein refers to abasic ribose moiety, an abasic deoxyribose moiety, a deoxyribonucleotide, a modified deoxyribonucleotide, a mirror nucleotide, a non-base pairing nucleotide analog and a nucleotide joined to an adjacent nucleotide by a 2'-5' internucleotide phosphate bond; bridged nucleic acids including LNA and ethylene bridged nucleic acids.

Abasic deoxyribose moiety includes for example abasic deoxyribose-3'-phosphate; 1,2-dideoxy-D-ribofuranose-3-phosphate; 1,4-anhydro-2-deoxy-D-ribitol-3-phosphate.

Inverted abasic deoxyribose moiety includes inverted deoxyriboabasic; 3',5' inverted deoxyabasic 5'-phosphate.

Mirror nucleotide includes for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror dU). The mirror nucleotide is a ribonucleotide (L-RNA) or a deoxyribonucleotide (L-DNA) and may further comprise at least one sugar or base modification and/or a backbone modification, such as a phosphorothioate or phosphonate moiety. U.S. Pat. No. 6,602,858 discloses nucleic acid catalysts comprising at least one L-nucleotide substitution.

Modified deoxyribonucleotide includes, for example 5'OMe DNA (5-methyl-deoxyriboguanosine-3'-phosphate) which may be useful as a nucleotide in the 5' terminal position (position number 1); PACE (deoxyriboadenine 3' phosphonoacetate, deoxyribocytidine 3' phosphonoacetate, deoxyriboguanosine 3' phosphonoacetate, deoxyribothymidine 3' phosphonoacetate.

Bridged nucleic acids include LNA (2'-O,4'-C-methylene bridged Nucleic Acid adenosine 3' monophosphate, 2'-O,4'-C-methylene bridged Nucleic Acid 5-methyl-cytidine 3' monophosphate, 2'-O,4'-C-methylene bridged Nucleic Acid guanosine 3' monophosphate, 5-methyl-uridine (or thymidine) 3' monophosphate); and ENA (2'-O,4'-C-ethylene bridged Nucleic Acid adenosine 3' monophosphate, 2'-O,4'-C-ethylene bridged Nucleic Acid 5-methyl-cytidine 3' monophosphate, 2'-O,4'-C-ethylene bridged Nucleic Acid guanosine 3' monophosphate, 5-methyl-uridine (or thymidine) 3' monophosphate).

In some embodiments of the present invention a preferred unconventional moiety is an abasic ribose moiety, an abasic deoxyribose moiety, a deoxyribonucleotide, a mirror nucleotide, and a nucleotide joined to an adjacent nucleotide by a 2'-5' internucleotide phosphate bond.

The nucleotides are selected from naturally occurring or synthetic modified bases. Naturally occurring bases include adenine, guanine, cytosine, thymine and uracil. Modified bases of nucleotides include inosine, xanthine, hypoxanthine, 2-aminoadenine, 6-methyl, 2-propyl and other alkyl adenines, 5-halo uracil, 5-halo cytosine, 6-aza cytosine and 6-aza thymine, pseudo uracil, 4-thiouracil, 8-halo adenine, 8-aminoadenine, 8-thiol adenine, 8-thiolalkyl adenines, 8-hydroxyl adenine and other 8-substituted adenines, 8-halo guanines, 8-amino guanine, 8-thiol guanine, 8-thioalkyl guanines, 8-hydroxyl guanine and other substituted guanines, other aza and deaza adenines, other aza and deaza guanines, 5-trifluoromethyl uracil and 5-trifluoro cytosine. Abasic pseudo-nucleotides are encompassed by the present invention. A nucleotide monomer comprising a modified base, including abasic pseudo-nucleotide monomers, may be substituted for one or more ribonucleotides of the oligonucleotide. An abasic pseudo-nucleotide monomer may be included at the one or more of the terminal positions or as a 5' terminal cap. A 5' terminal cap may also be selected from an inverted abasic pseudo-nucleotide analog, an L-DNA nucleotide, and a C6-imine phosphate.

In addition, analogues of polynucleotides are prepared wherein the structure of one or more nucleotide is fundamentally altered and better suited as therapeutic or experimental reagents. An example of a nucleotide analog is a peptide nucleic acid (PNA) wherein the deoxyribose (or ribose) phosphate backbone in DNA (or RNA comprises with a polyamide backbone which is similar to that found in peptides. PNA analogs have been shown to be resistant to enzymatic degradation and to have extended lives in vivo and in vitro.

Possible modifications to the sugar residue are manifold and include 2'-O alkyl, locked nucleic acid (LNA), glycol nucleic acid (GNA), threose nucleic acid (TNA), arabinoside; altritol (ANA) and other 6-membered sugars including morpholinos, and cyclohexinyls.

LNA compounds are disclosed in PCT Patent Publication Nos. WO 00/47599, WO 99/14226, and WO 98/39352. Examples of siRNA compounds comprising LNA nucleotides are disclosed in Elmen et al., (NAR 2005. 33(1):439-447) and in PCT Patent Publication No. WO 2004/083430. Six-membered ring nucleotide analogs are disclosed in Allart, et al (Nucleosides & Nucleotides, 1998, 17:1523-1526; and Perez-Perez, et al., 1996, Bioorg. and Medicinal Chem Letters 6:1457-1460) Oligonucleotides comprising 6-membered ring nucleotide analogs including hexitol and altritol nucleotide monomers are disclosed in PCT Patent Publication No. WO 2006/047842.

The compounds of the present invention are synthesized using one or more inverted nucleotides, for example inverted thymidine or inverted adenine (for example see Takei, et al., 2002. JBC 277(26):23800-06.

Backbone modifications, such as ethyl (resulting in a phospho-ethyl triester); propyl (resulting in a phospho-propyl triester); and butyl (resulting in a phospho-butyl triester) are also possible. Other backbone modifications include polymer backbones, cyclic backbones, acyclic backbones, thiophosphate-D-ribose backbones, amidates, phosphonoacetate derivatives. Certain structures include siRNA compounds having one or a plurality of 2'-5' internucleotide linkages (bridges or backbone).

In some embodiments, neither $(N)_x$ nor $(N')_y$ are phosphorylated at the 3' and 5' termini. In other embodiments either or both $(N)_x$ and $(N')_y$ are phosphorylated at the 3' termini (3' Pi). In yet another embodiment, either or both $(N)_x$ and $(N')_y$ are phosphorylated at the 3' termini with non-cleavable phosphate groups. In yet another embodiment, either or both $(N)_x$ and $(N')_y$ are phosphorylated at the terminal 2' termini position using cleavable or non-cleavable phosphate groups. Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks.

An "aptamer" is an RNA or DNA single-strand or double-strand oligonucleic acid which binds to a target protein and does not generally exhibit non-specific effects. Aptamers can be modified for stability or other desired qualities in accordance with the nucleic acid modifications disclosed herein and/or known to one of skill in the art. Modifications to an aptamer are introduced anywhere in the molecule, such as the 5' or 3' termini, or at any internally defined modification site. For example, RNA aptamers can be stabilized with 2'-fluoro or 2'-amino modified pyrimidines. Aptamers can also be linked to reporter molecules or linker chemistries and can be attached to beads or other solid support if necessary (e.g. 5' or 3' amino, thiol ester or biotin groups). Thioaptamers are aptamers which contain sulfur modifications at specific internucleoside phosphoryl sites, and may possess enhanced stability, nuclease resistance, target affinity and/or selectivity. Examples of thioaptamers include phosphoromonothioate (S-ODN) and phosphorodithioate (S2-ODN) oligodeoxy thioaptamers. For further information on aptamers and thioaptamers see for example U.S. Pat. Nos. 5,218,088 and 6,423,493.

Oligonucleotides

Tables A-H (SEQ ID NOS: 4-8,533) comprise nucleic acid sequences of sense and corresponding antisense oligomers, useful in preparing siRNA compounds. The compounds are used as chemically and or structurally modified compounds.

The selection and synthesis of siRNA corresponding to known genes has been widely reported: see for example Ui-Tei et al., J Biomed Biotechnol. 2006; 65052; Chalk et al., BBRC. 2004, 319(1):264-74; Sioud & Leirdal, Met. Mol Biol. 2004, 252:457-69; Levenkova et al., Bioinform. 2004, 20(3):430-2; Ui-Tei et al., NAR. 2004, 32(3):936-48. For examples of the use and production of modified siRNA see for example Braasch et al., Biochem. 2003, 42(26):7967-75; Chiu et al., RNA. 2003, 9(9):1034-48; PCT Patent Publication Nos. WO 2004/015107 and WO 02/44321 and U.S. Pat. Nos. 5,898,031 and 6,107,094.

The present invention provides double-stranded oligonucleotides (e.g. siRNAs), which down-regulate the expression of a desired gene. A siRNA of the invention is a duplex oligoribonucleotide in which the sense strand is derived from the mRNA sequence of the desired gene, and the antisense strand is at least substantially complementary to the sense strand. In general, some deviation from the target mRNA sequence is tolerated without compromising the siRNA activity (see e.g. Czauderna et al., NAR. 2003, 31(11):2705-2716). A siRNA of the invention inhibits gene expression on a post-transcriptional level with or without destroying the mRNA. Without being bound by theory, siRNA may target the mRNA for specific cleavage and degradation and/or may inhibit translation from the targeted message.

In some embodiments an oligonucleotide pair selected from Tables A-H comprises modified siRNA, having one or more of any of the modifications disclosed herein. In various embodiments the siRNA comprises an RNA duplex comprising a first strand and a second strand, whereby the first strand comprises a ribonucleotide sequence at least partially complementary to about 18 to about 40 consecutive nucleotides of a target nucleic acid which is mRNA transcribed from a target gene, and the second strand comprises a ribonucleotide sequence at least partially complementary to the first strand and wherein said first strand and or said second strand comprises a plurality of groups of modified ribonucleotides, optionally having a modification at the 2'-position of the sugar moiety whereby within each strand each group of modified ribonucleotides is flanked on one or both sides by a group of flanking nucleotides, optionally ribonucleotides, whereby each ribonucleotide forming the group of flanking ribonucleotides is selected from an unmodified ribonucleotide or a ribonucleotide having a modification different from the modification of the groups of modified ribonucleotides.

In some embodiments the group of modified ribonucleotides and/or the group of flanking nucleotides comprises a number of ribonucleotides selected from the group consisting of an integer from 1 to 12. Accordingly, the group thus comprises one nucleotide, two nucleotides, three nucleotides, four nucleotides, five nucleotides, six nucleotides, seven nucleotides, eight nucleotides, nine nucleotides, ten nucleotides, eleven nucleotides or twelve nucleotides.

The groups of modified nucleotides and flanking nucleotides may be organized in a pattern on one or both of the strands. In some embodiments the antisense and sense strands comprise alternating unmodified and 2' sugar modified ribonucleotides. In some preferred embodiments the middle ribonucleotide in the antisense strand is an unmodified nucleotide. For example, in a 19-oligomer antisense strand, ribonucleotide at position 10 is unmodified; in a 21-oligomer antisense strand, the ribonucleotide at position 11 is unmodified; and in a 23-oligomer antisense strand, ribonucleotide at position 12 is unmodified. The modifications or pattern of modification, if any, of the siRNA must be planned to allow for this. In an even-numbered oligomer, e.g. a 22 mer, the middle nucleotide may be at position 11 or 12.

Possible modifications on the 2' moiety of the sugar residue include amino, fluoro, methoxy alkoxy, alkyl, amino, fluoro, chloro, bromo, CN, CF, imidazole, caboxylate, thioate, $C_1$ to $C_{10}$ lower alkyl, substituted lower alkyl, alkaryl or aralkyl, $OCF_3$, OCN, O-, S-, or N-alkyl; O-, S, or N-alkenyl; $SOCH_3$; $SO_2CH_3$; $ONO_2$; $NO_2$, $N_3$; heterozycloalkyl; heterozycloalkaryl; aminoalkylamino; polyalkylamino or substituted silyl, as, among others, described in European patents EP 0 586 520 B1 or EP 0 618 925 B1. One or more deoxyribonucleotides are also tolerated in the compounds of the present invention. As used herein, in the description of any strategy for the design of molecules, RNAi or any embodiment of RNAi disclosed herein, the term "end modification" or "terminal cap" refers to a chemical entity added to the terminal 5' or 3' nucleotide of the sense and/or antisense strand. Examples for such end modifications include, but are not limited to, 3' or 5' phosphate, inverted abasic, abasic, amino, fluoro, chloro, bromo, CN, $CF_3$, methoxy, imidazolyl, caboxylate, phosphothioate, $C_1$ to $C_{22}$ and lower alkyl, lipids, sugars and polyaminoacids (i.e. peptides), substituted lower alkyl, alkaryl or aralkyl, $OCF_3$, OCN, O-, S-, or N-alkyl; O-, S-, or N-alkenyl; $SOCH_3$; $SO_2CH_3$; $ONO_2$; $NO_2$; $N_3$; heterocycloalkyl; heterocycloalkaryl; aminoalkylamino; polyalkylamino or substituted silyl, as, among others, described in European patents EP 0 586 520 B1 or EP 0 618 925 B1.

In some embodiments the siRNA is blunt ended, i.e. Z and Z' are absent, on one or both ends. More specifically, the siRNA may be blunt ended on the end defined by the 5'-terminus of the first strand and the 3'-terminus of the second strand, and/or the end defined by the 3'-terminus of the first strand and the 5'-terminus of the second strand.

In other embodiments at least one of the two strands may have an overhang of at least one nucleotide at the 5'-terminus; the overhang may consist of at least one deoxyribonucleotide. At least one of the strands may also optionally have an overhang of at least one nucleotide at the 3'-terminus. The overhang may consist of from about 1 to about 5 nucleotides.

The length of RNA duplex is from about 18 to about 40 ribonucleotides, preferably 19, 21 or 23 ribonucleotides. Further, the length of each strand may independently have a length selected from the group consisting of about 15 to about 40 bases, preferably 18 to 23 bases and more preferably 19, 21 or 23 ribonucleotides.

In certain embodiments the complementarity between said first strand and the target nucleic acid is perfect. In some embodiments, the strands are substantially complementary, i.e. having one, two or up to five mismatches between said first strand and the target mRNA or between the first and the second strands. Substantially complementary refers to complementarity of greater than about 70%, and less than 100% to another sequence. For example in a duplex region consisting of 19 base pairs one mismatch results in 94.7% complementarity, two mismatches results in about 89.5% complementarity, 3 mismatches results in about 84.2% complementarity, 4 mismatches results in about 79% complementarity and 5 mismatches results in about 74% complementarity, rendering the duplex region substantially complementary. Accordingly, substantially identical refers to identity of greater than about 70%, to another sequence.

The first strand and the second strand may be linked by a loop structure, which may be comprised of a non-nucleic acid polymer such as, inter alia, polyethylene glycol. Alternatively, the loop structure may be comprised of a nucleic acid, including modified and non-modified ribonucleotides and modified and non-modified deoxyribonucleotides.

Further, the 5'-terminus of the first strand of the siRNA may be linked to the 3'-terminus of the second strand, or the 3'-terminus of the first strand may be linked to the 5'-terminus of the second strand, said linkage being via a nucleic acid linker typically having a length between 2-100 nucleobases, preferably about 2 to about 30 nucleobases.

In preferred embodiments of the compounds of the invention having alternating ribonucleotides modified in at least one of the antisense and the sense strands of the compound, for 19 mer and 23 mer oligomers the ribonucleotides at the 5' and 3' termini of the antisense strand are modified in their sugar residues, and the ribonucleotides at the 5' and 3' termini of the sense strand are unmodified in their sugar residues. For 21 mer oligomers the ribonucleotides at the 5' and 3' termini of the sense strand are modified in their sugar residues, and the ribonucleotides at the 5' and 3' termini of the antisense strand are unmodified in their sugar residues, or may have an optional additional modification at the 3' terminus. As mentioned above, it is preferred that the middle nucleotide of the antisense strand is unmodified.

According to one preferred embodiment of the invention, the antisense and the sense strands of the oligonucleotide/siRNA are phosphorylated only at the 3'-terminus and not at the 5'-terminus. According to another preferred embodiment of the invention, the antisense and the sense strands are non-phosphorylated. According to yet another preferred embodiment of the invention, the 5' most ribonucleotide in the sense strand is modified to abolish any possibility of in vivo 5'-phosphorylation.

The siRNA compounds disclosed herein are prepared having any of the modifications/structures disclosed herein. The combination of sequence plus structure is novel and is useful used in the treatment of the conditions disclosed herein.

Pharmaceutical Compositions

While it may be possible for the compounds of the present invention to be administered as the raw chemical, it is preferable to present them as a pharmaceutical composition. Accordingly the present invention provides a pharmaceutical composition comprising one or more of the compounds of the invention; and a pharmaceutically acceptable carrier. This composition may comprise a mixture of two or more different siRNAs.

In certain embodiments the siRNA of the present invention is chemically modified and is delivered as naked siRNA. The term "naked siRNA" refers to siRNA molecules that are free from any delivery vehicle that acts to assist, promote or facilitate entry into the cell, including viral sequences, viral particles, liposome formulations, lipofectin, nanoparticles or precipitating agents and the like. For example, siRNA in water or PBS is "naked siRNA". Accordingly, the present invention provides a pharmaceutical composition comprising chemically modified, naked siRNA; and a pharmaceutically acceptable carrier.

The invention further provides a pharmaceutical composition comprising at least one compound of the invention covalently or non-covalently bound to one or more compounds of the invention in an amount effective to inhibit the target genes of the present invention; and a pharmaceutically acceptable carrier. In some embodiments the compound is processed intracellularly by endogenous cellular complexes to produce one or more oligoribonucleotides of the invention.

The invention further provides a pharmaceutical composition comprising a pharmaceutically acceptable carrier and one or more of the compounds of the invention in an amount effective to inhibit expression in a cell of a human target gene of the present invention, the compound comprising a sequence which is substantially complementary to 18-40 consecutive nucleotides of the target gene mRNA.

Additionally, the invention provides a method of inhibiting the expression of the target gene of the present invention by at least 20%, preferably 30%, even more preferably 40% or even 50%, 60%, 70%, 80%, 90%, 95%, 98% or 100% as compared to a control comprising contacting an mRNA transcript of the target gene of the present invention with one or more of the compounds of the invention.

In one embodiment the oligoribonucleotide is inhibiting the target gene of the present invention, whereby the inhibition is selected from the group comprising inhibition of gene function, inhibition of polypeptide and inhibition of mRNA expression.

In one embodiment the compound inhibits the target polypeptide, whereby the inhibition is selected from the group comprising inhibition of function (which may be examined by an enzymatic assay or a binding assay with a known interactor of the native gene/polypeptide, inter alia), inhibition of protein (which may be examined by Western blotting, ELISA or immuno-precipitation, inter alia) and inhibition of mRNA expression (which may be examined by Northern blotting, quantitative RT-PCR, in-situ hybridization or microarray hybridization, inter alia).

The pharmaceutically acceptable carriers, solvents, diluents, excipients, adjuvants and vehicles as well as implant carriers generally refer to inert, non-toxic solid or liquid fillers, diluents or encapsulating material not reacting with the active ingredients of the invention and they include liposomes and microspheres. Examples of delivery systems useful in the present invention include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many other such implants, delivery systems, and modules are well known to those skilled in the art. In one specific embodiment of this invention topical and transdermal formulations may be selected. The siRNAs or pharmaceutical compositions of the present invention are administered and dosed in accordance with good medical practice, taking into account the clinical condition of the individual subject, the disease to be treated, the site and method of administration, scheduling of administration, patient age, sex, body weight and other factors known to medical practitioners.

The "therapeutically effective dose" for purposes herein is thus determined by such considerations as are known in the art. The dose must be effective to achieve improvement including but not limited to improved survival rate or more rapid recovery, or improvement or elimination of symptoms and other indicators as are selected as appropriate measures by those skilled in the art.

In general, the active dose of compound for humans is in the range of from 1 ng/kg to about 20-100 mg/kg body weight per day, preferably about 0.01 mg to about 2-10 mg/kg body weight per day, in a regimen of one dose per day or twice or three or more times per day for a period of 1-4 weeks or longer. The compounds of the present invention can be administered by any of the conventional routes of administration. It should be noted that the compound can be administered as the compound or as pharmaceutically acceptable salt and can be administered alone or as an active ingredient in combination with pharmaceutically acceptable carriers, solvents, diluents, excipients, adjuvants and vehicles. The compounds can be administered orally, subcutaneously or parenterally including intravenous, intraarterial, intramuscular, intraperitoneally, and intranasal administration as well as intrathecal and infusion techniques. Implants of the compounds are also useful. Liquid forms may be prepared for injection, the term including subcutaneous, transdermal, intravenous, intramuscular, intrathecal, and other parental routes of administration. The liquid compositions include aqueous solutions, with and without organic co-solvents, aqueous or oil suspensions, emulsions with edible oils, surfactants as well as similar pharmaceutical vehicles. In a particular embodiment, the administration comprises intravenous administration. In another embodiment the administration comprises topical or local administration. In addition, in certain embodiments the compositions for use in the novel treatments of the present invention may be formed as an aerosol, for example for intranasal administration.

The present invention further provides for a pharmaceutical composition comprising two or more siRNA molecules for the treatment of any of the diseases and conditions mentioned herein, whereby said two molecules may be physically mixed together in the pharmaceutical composition in amounts which generate equal or otherwise beneficial activity, or may be covalently or non-covalently bound, or joined together by a nucleic acid linker of a length ranging from 2-100, preferably 2-50 or 2-30 nucleotides. In one embodiment, the siRNA molecules comprise a double-stranded nucleic acid structure as described herein, wherein the two siRNA sequences are selected from Tables A to H.

In another embodiment, the siRNA molecules are comprised of a double-stranded nucleic acid structure, wherein the first siRNA sequence is selected from Tables A to H, and the second siRNA molecule targets another cancer-related gene, thereby providing beneficial activity. The tandem double-stranded structure, which comprises two or more siRNA sequences, is processed intracellularly to form two or more different siRNAs. Such second siRNA molecule is for example an siRNA molecule that targets a cancer-related gene. Preferred cancer-related genes are for example gene encoding growth factors such as insulin-like growth factor (IGF), epidermal growth factor (EGF), fibroblast growth factor (FGF) and platelet derived growth factor (PDGF).

The siRNA molecules are covalently or non-covalently bound or joined by a linker to form a tandem siRNA molecule. Such tandem siRNA molecules comprising two siRNA sequences are typically of 38-150 nucleotides in length, more preferably 38 or 40-60 nucleotides in length, and longer accordingly if more than two siRNA sequences are included in the tandem molecule. A longer tandem molecule comprised of two or more sequences which encompass siRNA produced via internal cellular processing, e.g., long dsRNAs, is also envisaged, as is a tandem molecule encoding two or more siRNA or shRNA molecules. Such tandem molecules are also considered to be a part of the present invention.

In some embodiments siRNA molecules that target Nrf2 are the main active component in a pharmaceutical composition, or are one active component of a pharmaceutical composition containing two or more siRNAs (or molecules which encode or endogenously produce two or more siRNAs, be it a mixture of molecules or one or more tandem molecules which encode two or more siRNAs), said pharmaceutical composition further being comprised of one or more additional siRNA molecule which targets one or more additional gene. In some embodiments, simultaneous inhibition of Nrf2 and said additional gene(s) provide an additive or synergistic effect for treatment of the diseases disclosed herein.

In a preferred embodiment, the one or more additional siRNA molecules target a cancer-related gene, thus providing an additive or synergistic effect with the Nrf2 siRNA. In another embodiment, the additional siRNA molecules target one or more of the cancer-related genes defined above.

In some embodiments the pharmaceutical composition comprises a sIRNA compound according to the present invention and a chemotherapeutic agent.

As disclosed herein, an aptamer is useful in the present invention in combination with one or more of the novel siRNA compounds disclosed herein for targeting Nrf2 and for the treatment of any one of the conditions disclosed herein. For example, an aptamer can be used with any one of the siRNA compounds disclosed herein in combination therapy for the treatment of the conditions disclosed herein. In some embodiments the pharmaceutical composition employed for such a combination therapy, which is also part of the present invention, comprises a siRNA of the present invention covalently or non-covalently attached to an aptamer.

Methods of Treatment

In another aspect, the present invention relates to a method for the treatment of a subject in need of treatment for a disease or disorder associated with the abnormal expression of Nrf2, comprising administering to the subject an amount of an inhibitor which reduces or inhibits expression of Nrf2.

In preferred embodiments the subject being treated is a warm-blooded animal and, in particular, mammals including human.

The methods of the invention comprise administering to the subject one or more inhibitory compounds which down-regulate the expression of Nrf2; and in particular siRNA in a therapeutically effective dose so as to thereby treat the subject.

In various embodiments the inhibitor is siRNA. The term "treatment" refers to both therapeutic treatment and prophylactic or preventative measures, wherein the object is to prevent or slow down (lessen) related disorders as listed herein. Those in need of treatment include those already experiencing the disease or condition, those prone to having the disease or condition, and those in which the disease or condition is to be prevented. The compounds of the invention may be administered before, during or subsequent to the onset of the disease or condition or symptoms associated therewith. In cases where treatment is for the purpose of prevention, then the present invention relates to a method for delaying the onset of or averting the development of the disease or disorder.

The present invention relates to the use of compounds which down-regulate the expression of Nrf2 particularly to novel small interfering RNAs (siRNAs), in the treatment of the following diseases or conditions in which inhibition of the expression of Nrf2 is beneficial.

The invention further provides a vector capable of expressing any of the aforementioned oligoribonucleotides in unmodified form in a cell.

The invention also provides a composition comprising one or more of the compounds of the invention in a carrier, preferably a pharmaceutically acceptable carrier. This composition may comprise a mixture of two or more different siRNAs.

The invention also provides a composition which comprises the above compound of the invention covalently or non-covalently bound to one or more compounds of the invention in an amount effective to inhibit Nrf2 and a carrier. In some embodiments the composition is processed intracellularly by endogenous cellular complexes to produce one or more oligoribonucleotides of the invention.

More particularly, the invention provides an oligoribonucleotide wherein one strand comprises consecutive nucleotides having, from 5' to 3', the sequence set forth in Tables A, C, F1, G and H (19 mer siRNA molecules) or in Tables B, D and F2 (21 mer siRNA molecules), or in Tables E1, E2, F3 and F4 (23 mer siRNA molecules), or a homolog thereof wherein in up to 2 of the nucleotides in each terminal region a base is altered. Preferred 19 mer siRNA molecules comprising the sense and corresponding antisense sequences are listed in Tables H1-H5 (SEQ ID NOS: 8,490-8,533).

The terminal region of the oligonucleotide refers to bases 1-4 and/or 16-19 in the 19-mer sequence and to bases 1-4 and/or 18-21 in the 21-mer sequence.

The siRNA molecules of the present invention may be delivered to the target tissue (such as the lung) by direct application of the naked molecules admixed with a carrier or a diluent using an aerosol. For administration via the upper respiratory tract, the composition is formulated into a solution, e.g., water or isotonic saline, buffered or unbuffered, or as a suspension, at an appropriate concentration for oro-nasal i.e. by intubation, intratracheal, intranasal, administration as an aerosol. Preferably, such solutions or suspensions are isotonic relative to nasal secretions and of about the same pH, ranging e.g., from about pH 4.0 to about pH 7.4 or, from pH 6.0 to pH 7.0. Buffers should be physiologically compatible and include, simply by way of example, phosphate buffers. For example, a representative nasal decongestant is described as being buffered to a pH of about 6.2 (Remington's Pharmaceutical Sciences 16th edition, Ed. Arthur Osol, page 1445 (1980)). One skilled in the art can readily determine a suitable saline content and pH for an innocuous aqueous solution for nasal, intratracheal and/or tipper respiratory administration.

Other suitable aqueous vehicles include, but are not limited to, Ringer's solution and isotonic sodium chloride. Aqueous suspensions may include suspending agents such as cellulose derivatives, sodium alginate, polyvinyl-pyrrolidone and gum tragacanth, and a wetting agent such as lecithin. Suitable preservatives for aqueous suspensions include ethyl and n-propyl p-hydroxybenzoate.

The compositions may contain minor amounts of polymers, surfactants, or other excipients well known to those of the art. In this context, "minor amounts" means no auxiliary agents or substances are present that might affect or mediate uptake of nucleic acid in the cells of the lungs.

Aerosol dosage, formulations and delivery systems are selected for a particular therapeutic application, as described, for example, in Gonda, "Aerosols for delivery of therapeutic and diagnostic agents to the respiratory tract," in Critical Reviews in Therapeutic Drug Carrier Systems, 6:273-313, 1990; and in Moren, "Aerosol dosage forms and formulations," in: Aerosols in Medicine, Principles, Diagnosis and Therapy, Moren, et al., Eds. Elsevier, Amsterdam, 1985. The term "aerosol" as used herein refers to any preparation of a fine mist of particles, which can be in solution or a suspension, whether or not it is produced using a propellant. Aerosols can be produced using standard techniques, such as ultrasonication or high pressure treatment.

Various suitable devices and methods of inhalation which can be used to administer particles to a patient's respiratory tract are known in the art. Nebulizers create a fine mist from a solution or suspension, which is inhaled by the patient. The devices described in U.S. Pat. No. 5,709,202 to Lloyd, et al., can be used. An MDI typically includes a pressurized canister having a meter valve, wherein the canister is filled with the solution or suspension and a propellant. The solvent itself may function as the propellant, or the composition may be combined with a propellant, such as freon. The composition is a fine mist when released from the canister due to the release in pressure. The propellant and solvent may wholly or partially evaporate due to the decrease in pressure. Other types of nebulizers which can be used to administer the molecules of the invention to a patient's respiratory tract are disclosed in co-pending PCT application number PCT/IL2008/000522, incorporated herein by reference.

Delivery systems aimed specifically at the enhanced and improved delivery of siRNA into mammalian cells have been developed, see, for example, Shen et al (FEBS letters 539: 111-114 (2003)), Xia et al., Nature Biotechnology 20: 1006-1010 (2002), Reich et al., Molecular Vision 9: 210-216 (2003), Sorensen et al. (J. Mol. Biol. 327: 761-766 (2003), Lewis et al., Nature Genetics 32: 107-108 (2002) and Simeoni et al., Nucleic Acids Research 31, 11: 2717-2724 (2003). siRNA has recently been successfully used for inhibition in primates; for further details see Tolentino et al., Retina 24(1) February 2004 I 132-138. Respiratory formulations for siRNA are described in U.S. patent application No. 2004/0063654 of Davis et al. Cholesterol-conjugated siRNAs (and other steroid and lipid conjugated siRNAs) can been used for delivery see Soutschek et al Nature 432: 173-177(2004); and Lorenz et al. Bioorg. Med. Chemistry. Lett. 14:4975-4977 (2004).

The siRNAs or pharmaceutical compositions of the present invention are administered and dosed in accordance with good medical practice, taking into account the clinical condition of the individual patient, the disease to be treated, the site and method of administration, scheduling of administration, patient age, sex, body weight and other factors known to medical practitioners.

The "therapeutically effective dose" for purposes herein is thus determined by such considerations as are known in the art. The dose must be effective to achieve improvement including but not limited to improved survival rate or more rapid recovery, or improvement or elimination of symptoms and other indicators as are selected as appropriate measures by those skilled in the art. The compounds of the present invention can be administered by any of the conventional routes of administration. It should be noted that the compound can be administered as the compound or as pharmaceutically acceptable salt and can be administered alone or as an active ingredient in combination with pharmaceutically acceptable carriers, solvents, diluents, excipients, adjuvants and vehicles. The compounds can be administered orally, subcutaneously or parenterally including intravenous, intraarterial, intramuscular, intraperitoneally, and intranasal administration as well as intrathecal and infusion techniques. Implants of the compounds are also useful. Liquid forms may be prepared for injection, the term including subcutaneous, transdermal, intravenous, intramuscular, intrathecal, and other parental routes of administration. The liquid compositions include aqueous solutions, with and without organic co-solvents, aqueous or oil suspensions, emulsions with edible oils, as well as similar pharmaceutical vehicles. In addition, under certain circumstances the compositions for use in the novel treatments of the present invention may be formed as aerosols, for intranasal and like administration. The patient being treated is a warm-blooded animal and, in particular, mammals including man. The pharmaceutically acceptable carriers, solvents, diluents, excipients, adjuvants and vehicles as well as implant carriers generally refer to inert, non-toxic solid or liquid fillers, diluents or encapsulating material not reacting with the active ingredients of the invention and they include liposomes and microspheres. Examples of delivery systems useful in the present invention include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many other such implants, delivery systems, and modules are well known to those skilled in the art. In one specific embodiment of this invention topical and transdermal formulations are particularly preferred.

The term "treatment" as used herein refers to administration of a therapeutic substance effective to ameliorate symptoms associated with a disease, to lessen the severity or cure the disease, or to prevent the disease from occurring. Thus "treatment" refers to both therapeutic treatment and prophylactic or preventative measures, wherein the object is to prevent or slow down (lessen) a disease in particular a cancerous disease such as lung cancer, breast cancer, cervical cancer, colon cancer, gastric cancer, kidney cancer, leukemia, liver cancer, lymphoma, ovarian cancer, pancreatic cancer, prostate cancer, rectal cancer, sarcoma, skin cancer, testicular cancer, and uterine cancer. In a particular embodiment, the cancer is lung cancer such as non-small-cell lung carcinoma (NSCLC) or small-cell lung carcinoma.

In another aspect, the present invention provides a pharmaceutical composition comprising any of the above oligoribonucleotides or vectors and a pharmaceutically acceptable carrier. Another aspect of the invention is the use of a therapeutically effective amount of any of the above oligoribonucleotides or vectors for the preparation of a medicament for treating a patient suffering from a cancerous disease.

"Cancer and "cancerous disease" are used interchangeably and refer to a disease that is caused by or results in inappropriately high levels of cell division, inappropriately low levels of apoptosis, or both. Examples of cancerous diseases include, without limitation, leukemias (e.g., acute leukemia, acute lymphocytic leukemia, acute myelocytic leukemia, acute myeloblastic leukemia, acute promyelocytic leukemia, acute myelomonocytic leukemia, acute monocytic leukemia, acute erythroleukemia, chronic leukemia, chronic myelocytic leukemia, chronic lymphocytic leukemia), polycythemia vera, lymphoma (Hodgkin's disease, non-Hodgkin's disease), Waldenstrom's macroglobulinemia, heavy chain disease, and solid tumors such as sarcomas and carcinomas (e.g., fibrosarcoma, myxosarcoma, liposarcoma, chondrosarcoma, osteogenic sarcoma, chordoma, amgiosarcoma, endotheliosarcoma, lymphangio sarcoma, lymphangioendotheliosarcoma, synovioma, mesothelioma, Ewing's tumor, leiomyo sarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, nile duct carcinoma, choriocarcinoma, seminoma, embryonal carcinoma, Wilm's tumor, cervical cancer, uterine cancer, testicular cancer, lung carcinoma, small cell lung carcinoma, bladder carcinoma, epithelial carcinoma, glioma, astrocytoma, medulloblastoma, crailiopharyngioma, ependymoma, pinealoma, hemangioblastoma, acoustic neuroma, oligodenroglioma, schwamioma, meningioma, melanoma, neuroblastoma, and retinoblastoma). In some preferred embodiments the compounds of the present invention are useful in treating lung cancer and metastases in the lung.

As used herein, the term "proliferative disease" refers to any disease in which cellular proliferation, either malignant or benign, contributes to the pathology of the condition. Such unwanted proliferation is the hallmark of cancer and many chronic inflammatory diseases, thus examples of "proliferative disease" include the cancers listed supra and chronic inflammatory proliferative diseases such as psoriasis, inflammatory bowel disease and rheumatoid arthritis; proliferative cardiovascular diseases such as restenosis; proliferative ocular disorders such as diabetic retinopathy; and benign hyperproliferative diseases such as hemangiomas.

In one embodiment, the present invention provides a pharmaceutical composition comprising an Nrf2 inhibitory molecule, preferable an siRNA molecule that decreases the expression of the Nrf2 gene in combination with a chemotherapeutic agent. Without being bound by theory, since Nrf2 positively regulates drug detoxification enzymes, targeting this molecule may have a broad effect on all anticancer drugs. In various embodiments, the Nrf2 inhibitory molecule is administered prior to, concurrently with, or following administration of a chemotherapeutic. Without wishing to be bound by theory, administration of an Nrf2 inhibitory molecule likely enhances the accumulation or efficacy of a chemotherapeutic agent.

Compositions and methods of the invention may be used in combination with any conventional therapy known in the art. In one embodiment, the Nrf2 inhibitory molecules of the invention may be used in combination with cancer therapy known in the art. Thus the Nrf2 inhibitors may be used before, during or following cancer therapy. Exemplary cancer therapies include, for example, chemotherapy, cryotherapy, hormone therapy, growth factor inhibitors, radiotherapy, and surgery. Chemotherapeutic agents include abiraterone acetate, altretamine, anhydrovinbiastine, auristatin, bexarotene, bicalutamide, BMS 184476, 2,3,4,5,6-pentafluoro-N-(3-fluoro-4-methoxyphenyl)benzene sulfonamide, bleomycin, N,N-dimethyl-L-valyl-L-valyl-N-methyl-L-valyl-L-proly-l-L-proline-t-butylamide, cachectin, cernadotin, chiorambucil, cyclophosphamide, 3',4'-didehydro-4'-deoxy-8'-norvincaleukoblastine, docetaxol, doxetaxel, cyclophosphamide, carboplatin, carmustine (BCNTJ), cisplatin, cryptophycin, cyclophosphamide, cytarabine, dacarbazine (DTIC), dactinomycin, daunorubicin, dolastatin, doxorubicin (adriamycin), etoposide, 5-fluorouracil, finasteride, flutamide, hydroxyurea and hydroxyureataxanes, ifosfamide, liarozole, lonidamine, lomustine (CCNU), mechlorethamine (nitrogen mustard), melphalan, mivobulin isethionate, rhizoxin, sertenef, streptozocin, mitomycin, methotrexate, 5-fluorouracil, nilutamide, onapristone, oxaliplatin paclitaxel, prednimustine, procarbazine, RPR1 09881, satrapaltin, stramustine phosphate, tamoxifen, tasonermin, taxol, tretinoin, vinbiastine, vincristine, vindesine sulfate, and vinflunine. Other examples of chemotherapeutic agents can be found in Cancer Principles and Practice of Oncology by V. T. Devita and S. Heliman (editors), 6th edition (Feb. 15, 2001), Lippincott Williams & Wilkins Publishers. A preferred combination according to the present invention is an siRNA molecule targeting Nrf2 with platinum drugs, more preferably an siRNA molecule set forth in Table C with a platinum drug, preferably carboplatin. Without being bound by theory, the Nrf2 siRNA inhibitors of the invention are found to be efficient promoters for the antineoplastic potential of platinum drugs, causing additive/synergistic effects in cancer cells. Platinum drugs include carboplatin, cisplatin, oxaliplatin and satrapaltin inter alia; see Kelland and Farrell, Platinum-based drugs in cancer therapy (Cancer drug discovery & development) Lavoisier 2000, which is hereby incorporated by reference.

The compounds which reduce or prevent the cancerous or proliferative disease, such as lung cancer, e.g. the novel siRNAs inter alia are preferably administered directly to the inner lung as naked siRNA in a vehicle such as PBS or other physiological solutions, but may alternatively be administered with a delivery vehicle as described above.

The present invention also provides for a process of preparing a pharmaceutical composition, which comprises:
obtaining one or more double stranded compound of the invention; and
admixing said compound with a pharmaceutically acceptable carrier, thereby obtaining the pharmaceutical compositions of the invention The present invention also provides for a process of preparing a pharmaceutical composition, which comprises admixing one or more compounds of the present invention with a pharmaceutically acceptable carrier.

In a preferred embodiment, the compound used in the preparation of a pharmaceutical composition is admixed with a carrier in a pharmaceutically effective dose. In a particular embodiment the compound of the present invention delivered as naked siRNA. In another embodiment the compound is conjugated to a steroid or to a lipid or to another suitable delivery molecule e.g. to cholesterol.

Oligonucleotide Synthesis

The compounds of the present invention can be synthesized by any of the methods that are well-known in the art for synthesis of ribonucleic (or deoxyribonucleic) oligonucleotides. Such synthesis is, among others, described in Beaucage and Iyer, Tetrahedron 1992; 48: 2223-2311, Beaucage and Iyer, Tetrahedron 1993; 49: 6123-6194 and Caruthers et. al., Methods Enzymol. 1987; 154: 287-313; the synthesis of thioates is, among others, described in Eckstein F., Annu. Rev. Biochem. 1985; 54: 367-402, the synthesis of RNA molecules is described in Sproat, in Humana Press 2005 edited by Herdewijn; Kap. 2: 17-31 and respective downstream processes are, among others, described in Pingoud A. et. al., in IRL Press 1989 edited by Oliver; Kap. 7: 183-208 and Sproat, in Humana Press 2005 edited by Herdewijn; Kap. 2: 17-31 (supra).

Other synthetic procedures are known in the art e.g. the procedures as described in Usman et al., 1987, J. Am. Chem. Soc., 109, 7845; Scaringe et al., 1990, Nucleic Acids Res., 18, 5433; Wincott et al., 1995, Nucleic Acids Res. 23, 2677-2684; and Wincott et al., 1997, Methods Mol. Bio., 74, 59, and these procedures may make use of common nucleic acid protecting and coupling groups, such as dimethoxytrityl at the 5'-end, and phosphoramidites at the 3'-end. The modified (e.g. 2'-O-methylated) nucleotides and unmodified nucleotides are incorporated as disclosed herein.

The oligonucleotides of the present invention can be synthesized separately and joined together post-synthetically, for example, by ligation (Moore et al., 1992, *Science* 256, 9923; Draper et al., PCT Patent Publication No. WO93/23569; Shabarova et al., 1991, Nucleic Acids Research 19, 4247; Bellon et al., 1997, Nucleosides & Nucleotides, 16, 951; Bellon et al., 1997, Bioconjugate Chem. 8, 204), or by hybridization following synthesis and/or deprotection.

It is noted that a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded siRNAs are separated from the single-stranded oligonucleotides that were not annealed (e.g. because of the excess of one of them) by HPLC. In relation to the siRNAs or siRNA fragments of the present invention, two or more such sequences can be synthesized and linked together for use in the present invention.

The compounds of the invention can also be synthesized via a tandem synthesis methodology, as described in US Patent Application Publication No. US2004/0019001 (McSwiggen), wherein both siRNA strands are synthesized as a single contiguous oligonucleotide fragment or strand separated by a cleavable linker which is subsequently cleaved to provide separate siRNA fragments or strands that hybridize and permit purification of the siRNA duplex. The linker can be a polynucleotide linker or a non-nucleotide linker.

Additionally, in some embodiments the siRNA disclosed herein or any nucleic acid molecule comprising or encoding the siRNA is linked or bound (covalently or non-covalently) to an antibody or aptamer against a cell surface internalizable molecule expressed on a target cell, in order to achieve enhanced targeting for treatment of the diseases disclosed herein. For example, an anti-Fas antibody (preferably a neutralizing antibody) is combined (covalently or non-covalently) with a Nrf2 siRNA molecule for administering to a subject in need thereof. In another example, an aptamer which can act like a ligand/antibody is combined (covalently or non-covalently) with a Nrf2 siRNA molecule.

The term "Covalent bonding" as used herein refers to chemical bonding that is characterized by the sharing of pairs of electrons between atoms.

The term "Noncovalent bonding" as used herein refers to a variety of interactions that are not covalent in nature between molecules or parts of molecules that provide force to hold the molecules or parts of molecules together, usually in a specific orientation or conformation. These noncovalent interactions include: ionic bonds, hydrophobic interactions, hydrogen bonds, Van der Waals forces and dipole-dipole bonds.

The compounds of the present invention can be delivered either directly or with viral or non-viral vectors. When delivered directly the sequences are generally rendered nuclease resistant. Alternatively the sequences can be incorporated into expression cassettes or constructs such that the sequence is expressed in the cell as discussed herein below. Generally the construct contains the proper regulatory sequence or promoter to allow the sequence to be expressed in the targeted cell. Vectors optionally used for delivery of the compounds of the present invention are commercially available, and may be modified for the purpose of delivery of the compounds of the present invention by methods known to one of skill in the art.

It is also envisaged that a long oligonucleotide (typically 25-500 nucleotides in length) comprising one or more stem and loop structures, where stem regions comprise the sequences of the oligonucleotides of the invention, may be delivered in a carrier, preferably a pharmaceutically acceptable carrier, and may be processed intracellularly by endogenous cellular complexes (e.g. by DROSHA and DICER as described above) to produce one or more smaller double stranded oligonucleotides (siRNAs) which are oligonucleotides of the invention. This oligonucleotide can be termed a tandem shRNA construct. It is envisaged that this long oligonucleotide is a single stranded oligonucleotide comprising one or more stem and loop structures, wherein each stem region comprises a sense and corresponding antisense siRNA sequence of an Nrf2 gene. In particular, it is envisaged that this oligonucleotide comprises sense and antisense siRNA sequences present in Tables A-H (SEQ ID NOS: 4-8,533).

As used herein, the term "inhibition" of the Nrf2 gene means inhibition of the gene expression (transcription or translation) or polypeptide activity.

Screening of Inactivation Compounds for Nrf2:

Some of the compounds and compositions of the present invention may be used in a screening assay for identifying and isolating compounds that modulate the activity of the Nrf2 gene, in particular compounds that modulate a disorder accompanied by an elevated level of Nrf2. The compounds to be screened comprise inter alia substances such as small chemical molecules and antisense oligonucleotides.

The inhibitory activity of the compounds of the present invention on Nrf2 expression may be used to determine the interaction of an additional compound with the target polypeptide, e.g., if the additional compound competes with the oligonucleotides of the present invention for inhibition of Nrf2, or if the additional compound rescues said inhibition. The inhibition or activation can be tested by various means, such as, inter alia, assaying for the product of the activity of the Nrf2 polypeptide or displacement of binding compound from the Nrf2 polypeptide in radioactive or fluorescent competition assays.

The present invention is illustrated in detail below with reference to the Examples, but is not to be construed as being limited thereto.

Citation of any document herein is not intended as an admission that such document is pertinent prior art, or considered material to the patentability of any claim of the present application. Any statement as to content or a date of any document is based on the information available to applicant at the time of filing and does not constitute an admission as to the correctness of such a statement.

EXAMPLES

General Methods in Molecular Biology

Standard molecular biology techniques known in the art and not specifically described were generally followed as in Sambrook et al., Molecular Cloning: A Laboratory Manual, Cold Spring Harbor Laboratory Press, New York (1989), and as in Ausubel et al., Current Protocols in Molecular Biology, John Wiley and Sons, Baltimore, Md. (1989) and as in Perbal, A Practical Guide to Molecular Cloning, John Wiley & Sons, New York (1988), and as in Watson et al., Recombinant DNA, Scientific American Books, New York and in Birren et al (eds) Genome Analysis: A Laboratory Manual Series. Vols. 1-4 Cold Spring Harbor Laboratory Press, New York (1998) and methodology as set forth in U.S. Pat. Nos. 4,666,828; 4,683, 202; 4,801,531; 5,192,659 and 5,272,057 and incorporated herein by reference. Polymerase chain reaction (PCR) was carried out generally as in PCR Protocols: A Guide To Methods And Applications, Academic Press, San Diego, Calif. (1990). In situ (In cell) PCR in combination with Flow Cytometry can be used for detection of cells containing specific DNA and mRNA sequences (Testoni et al., 1996, Blood 87:3822.) Methods of performing RT-PCR are also well known in the art.

Example 1

Generation of Sequences for Active siRNA Compounds

Using proprietary algorithms and the known sequence of Nrf2 (gi2014957), the sense and antisense sequences of many potential siRNAs were generated. These sequences are listed in Tables A-H (set forth in SEQ ID NOS: 4-8,533). Tables A, C, F1, G and H show a list of 19-mers siRNAs specific to Nrf2 which are either human-specific, or human and cross-species with other species. Tables B, D and F2 show a list of 21-mers siRNAs specific to Nrf2 winch are either human-specific, or human and cross-species with other species. Tables E1, E2, F3 and F4 show a list of 23-mers siRNAs specific to Nrf2 which are either human-specific, or human and cross-species with other species. All siRNAs are depicted in 5' to 3' orientation, and the sense and complementary antisense sequences are depicted on the same line in the tables.

Example 2

In Vitro Testing of siRNA Compounds for Nrf2

1. General 1.5-2×10$^5$ tested cells (HeLa or 293 cells) are seeded per well in a 6-well plate (70-80% confluent).

About 24 h later, cells were transfected with siRNA oligos using lipofectamine 2000 reagent (Invitrogene) at a final concentration of 500 pM, 5 nM, 20 nM or 40 nM. The cells were incubated at 37° C. in a $CO_2$ incubator for 72 h.

As positive control for cell transfection, PTEN-Cy3 labeled siRNA oligos were used. As negative control for siRNA activity, GFP siRNA oligos were used. About 72 h after transfection cells were harvested and RNA was extracted from cells. Transfection efficiency was tested by fluorescent microscopy.

The percent of inhibition of gene expression using specific preferred siRNAs was determined by using qPCR analysis of target gene in cells expressing the endogenous gene. Tables H1-H5 below listed the currently preferred sequences which were tested in vitro for inhibition of Nrf2 expression.

TABLE H1 sense and antisense oligonucleotides are in the 5'-3' orientation

| Active siRNA | Sequence |
| --- | --- |
| NFE2L2_10 (Sense: SEQ ID NO: 8490; Antisense SEQ ID NO: 8499) | Sense: CCCUGUCGAAAAAAUCAUU Antisense: AAUGAUUUUUCGACAGGG having one mismatch (underlined) compared to the human sequence |
| NFE2L2_4 (Sense: SEQ ID NO: 8491; Anitsense:SEQ ID NO: 8500) | Sense: CCAUUCACAAAAGACAAA Antisense: UUUGUCUUUUGUGAAUGGG |
| NFE2L2_5 (Sense: SEQ ID NO: 8492; Antisense: SEQ ID NO: 8501) | Sense: CAGCAGGACAUGGAUUUGA Antisense: UCAAAUCCAUGUCCUGCUG |
| NFE2L2_9 (Sense: SEQ ID NO: 8493; Antisense: SEQ ID NO: 8502) | Sense: UCCCUGUCGAAAAAAUCAU Antisense: AUGAUUUUUUCCACAGGGA |
| NFE2L2_11 (Sense: SEQ ID NO: 8494; Antisense: SEQ ID 8503) | Sense: CCUGUCGAAAAAAUCAUUA Antisense: UAAUGAUUUUUUCGACAGG |
| NFE2L2_1 (Sense: SEQ ID NO: 8495; Antisense: SEQ ID NO: 8504) | Sense: GGAGGGGUAAGAAUAAAGU Antisense: ACUUUAUUCUUACCCCUCC |
| NFE2L2_2 (Sense: SEQ ID NO: 8496; Antisense: SEQ ID NO: 8505) | Sense: GCCCUCACCUGCUACUUUA Antisense: UAAAGUAGCAGGUGAGGGC |
| NFE2L2_3 (Sense: SEQ ID NO: 8497; Antisense: SEQ ID NO: 8506) | Sense: UCCCGUUUCUACAUGACAA Antisense: UUGUCAUCUACAAACCGGA |
| NFE2L2_12 (Sense: SEQ ID NO: 8498; Antisense: SEQ ID NO: 8507) | Sense: GUAAGAAGCCAGAUGUUAA Antisense: UUAACAUCUGGCUUCUUAC |

TABLE H2 sense and antisense oligonucleotides are in the 5'-3' orientation. All molecules in Table H2 were modified with alternating 2-O-methyl modification in both strands.

| SiRNA number | Sense | Antisense | Residual activity in vitro |
| --- | --- | --- | --- |
| NFE2L2_4 | CCCAUUCACAAAAGACAAA SEQ ID NO: 8491 | UUUGUCUUUUGUGAAUGGG SEQ ID NO: 8500 | 20 |
| NFE2L2_5 | CAGCAGGACAUGGAUUUGA SEQ ID NO: 8492 | UCAAAUCCAUGUCCUGCUG SEQ ID NO: 8501 | 30 |
| NFE2L2_9 | UCCCUGUCGAAAAAAUCAU SEQ ID NO: 8493 | AUGAUUUUUUCGACAGGGA SEQ ID NO: 8502 | 56 |
| NFE2L2_10 | CCCUGUCGAAAAAAUCAUU SEQ ID NO: 8490 | AAUGAUUUUUCGACAGGG SEQ ID NO: 8499 | 9 |

TABLE H2-continued sense and antisense oligonucleotides are in the
5'-3' orientation. All molecules in Table H2 were
modified with alternating 2-O-methyl modification in both strands.

| SiRNA number | Sense | Antisense | Residual activity in vitro |
|---|---|---|---|
| NFE2L2_11 | CCUGUCGAAAAAAUCAUUA; SEQ ID NO: 8494 | UAAUGAUUUUUUCGACAGG SEQ ID NO: 8503 | 54 |
| NFE2L2_1 | GGAGGGGUAAGAAUAAAGU SEQ ID NO: 8495 | ACUUUAUUCUUACCCCUCC SEQ ID NO: 8504 | 27 |
| NFE2L2_2 | GCCCUCACCUGCUACUUUA SEQ ID NO: 8496 | UAAAGUAGCAGGUGAGGGC SEQ ID NO: 8505 | 8 |
| NFE2L2_3 | UCCCGUUUGUAGAUGACAA SEQ ID NO: 8497 | UUGUCAUCUACAAACGGGA SEQ ID NO: 8506 | 4 |
| NFE2L2_12 | GUAAGAAGCCAGAUGUUAA SEQ ID NO: 8498 | UUAACAUCUGGCUUCUUAC SEQ ID NO: 8507 | 4 |
| NFE2L2_13 | CCCUGUAGAAAAAAUCAUU SEQ ID NO: 8508 | AAUGAUUUUUUCUACAGGG SEQ ID NO: 8521 | 11 |
| NFE2L2_14 | CCUGGAAGUGUCAAACAGA SEQ ID NO: 8509 | UCUGUUUGACACUUCCAGG SEQ ID NO: 8522 | |
| NFE2L2_16 | GGGCAAAAGCUCUCCAUAU SEQ ID NO: 8510 | AUAUGGAGAGCUUUUGCCC SEQ ID NO: 8523 | |
| NFE2L2_18 | CUGGAAGUGUCAAACAGAA SEQ ID NO: 8511 | UUCUGUUUGACACUUCCAG SEQ ID NO: 8524 | |
| NFE2L2_19 | UGAGCUGGAAAAACAGAAA SEQ ID NO: 8512 | UUUCUGUUUUUCCAGCUCA SEQ ID NO: 8525 | |
| NFE2L2_20 | GAGCUGGAAAAACAGAAAA SEQ ID NO: 8513 | UUUUCUGUUUUUCCAGCUC SEQ ID NO: 8526 | |
| NFE2L2_21 | ACAAAAGACAAACAUUCAA SEQ ID NO: 8514 | UUGAAUGUUUGUCUUUUGU SEQ ID NO: 8527 | |
| NFE2L2_24 | CAUUCACAAAAGACAAACA SEQ ID NO: 8515 | UGUUUGUCUUUUGUGAAUG SEQ ID NO: 8528 | |
| NFE2L2_26 | GCAGGACAUGGAUUUGAUU SEQ ID NO: 8516 | AAUCAAAUCCAUGUCCUGC SEQ ID NO: 8529 | |
| NFE2L2_28 | AGCAGGACAUGGAUUUGAU SEQ ID ND: 8517 | AUCAAAUCCAUGUCCUGCU SEQ ID NO: 8530 | |
| NFE2L2_30 | GACAUGGAUUUGAUUGACA SEQ ID NO: 8518 | UGUCAAUCAAAUCCAUGUC SEQ ID NO: 8531 | |
| NFE2L2_32 | AGGGCAAAAGCUCUCCAUA SEQ ID NO: 8519 | UAUGGAGAGCUUUUGCCCU SEQ ID NO: 8532 | |
| NFE2L2_33 | AGGUUGCCCACAUUCCCAA SEQ ID NO: 8520 | UUGGGAAUGUGGGCAACCU SEQ ID NO: 8533 | |

TABLE H3

All modifications preformed on the NFE2L2_3 molecule ( Sen: SEQ ID NO: 8497; AS: SEQ ID NO: 8506). Sense strand is 5'-3'orientation; Antisense strand is 3'-5' orientation.
The molecules in Table H3 were modified as following:
Bold: 2-O-methyl sugar modified ribonucleotide
<u>underlined</u>: ENA (2'-O,4'-C-Ethylene-bridged nucleotide)
small case: L-DNA
\*: 2'-5' internucleosidelinkage; 3'p: phosphate in the 3' end; ^: PACE linkage.
Table H3.

| SiRNA number and ID | Description of modifications | | Residual activity in vitro at 20nM (% of control) |
|---|---|---|---|
| NFE2L2_3 | Sense: | 5'- <u>U</u>CCCGUUUGUAGAUGACAA | 30% |
|  | Antisense: | 3'- AGGGCAAACAUCUACUGUU |  |
| NFE2L2_3 | Sense: | 5'- <u>UC</u>CCGUUUGUAGAUGACAA | 36% |
|  | Antisense: | 3'- AGGGCAAACAUCUACUGUU |  |
| NFE2L2_3 | Sense: | 5'- <u>UCC</u>CGUUUGUAGAUGACAA | 45% |
|  | Antisense: | 3'- AGGGCAAACAUCUACUGUU |  |
| NFE2L2_3 | Sense: | 5'- <u>UCCC</u>GUUUGUAGAUGACaa | 6% |
|  | Antisense: | 3'- AGGGCAAACAUCUACUGUU |  |
| NFE2L2_3 | Sense: | 5'- <u>UCCC</u>GUUUGUAGAUGAcaA | 24% |
|  | Antisense: | 3'- AGGGCAAACAUCUACUGUU |  |
| NFE2L2_3 | Sense: | 5'- <u>UCCC</u>GUUUGUAGAUGAC\*A\*A | 11% |
|  | Antisense: | 3'- AGGGCAAACAUCUACUGUU |  |
| NFE2L2_3 | Sense: | 5'- <u>UCCC</u>GUUUGUAGAUGA\*C\*AA | 34% |
|  | Antisense: | 3'- AGGGCAAACAUCUACUGUU |  |
| NFE2L2_3 | Sense: | 5'- <u>UCCC</u>GUUUGUAGAUGACAA | 41% |
|  | Antisense | 3'- <u>AGGG</u>CAAACAUCUACUGUU |  |
| NFE2L2_3 | Sense: | 5'- <u>UCCC</u>GUUUGUAGAUGACAA | 35% |
|  | Antisense: | 3'- <u>AGGG</u>CAAACAUCUACUGUU |  |
| NFE2L2_3 | Sense: | 5'- <u>UCCC</u>GUUUGUAGAUGACAA | 50% |
|  | Antisense: | 3'- <u>AGGG</u>CAAACAUCUACUGUU |  |
| NFE2L2_3 | Sense: | 5'- <u>UCCC</u>GUUUGUAGAUGACaa | 32% |
|  | Antisense: | 3'- <u>AGGG</u>CAAACAUCUACUGUU |  |
| NFE2L2_3 | Sense: | 5'- <u>UCCC</u>GUUUGUAGAUGAcaA | 49% |
|  | Antisense: | 3'- <u>AGGG</u>CAAACAUCUACUGUU |  |
| NFE2L2_3 | Sense: | 5'- <u>UCCC</u>GUUUGUAGAUGAC\*A\*A | 38% |
|  | Antisense: | 3'- <u>AGGG</u>CAAACAUCUACUGUU |  |
| NFE2L2_3 | Sense: | 5'- <u>UCCC</u>GUUUGUAGAUGA\*C\*AA | 58% |
|  | Antisense: | 3'- <u>AGGG</u>CAAACAUCUACUGUU |  |
| NFE2L2_3 | Sense: | 5'- UCCCGUUUGUAGAUGAC\*A\*A | 12% |
|  | Antisense: | 3'- AGGGCAAACAUCUACUGUU |  |
| NFE2L2_3 | Sense: | 5'- UCCCGUUUGUAGAUGAC\*A\*A-3'p | 15% |
|  | Antisense: | 3'- AGGGCAAACAUCUACUGUU |  |
| NFE2L2_3 | Sense: | 5'- UCCCGUUUGUAGAUGACaa-3'p | 13% |
|  | Antisense: | 3'- AGGGCAAACAUCUACUGUU |  |
| NFE2L2_3 | Sense: | 5'- UCCCGUUUGUAGAUGACaa | 9% (in 5nM) |
|  | Antisense: | 3'- AGGGCAAACAUCUACUGUU |  |
| NFE2L2_3 | Sense: | 5'- UCCCGUUUGUAGAUGACaa-3'p | 13% |
|  | Antisense: | 3'- AGGGCAAACAUCUACUGUU |  |
| NFE2L2_3 | Sense: | 5'- UCCCGUUUGUAGAUGACaa | 21% |
|  | Antisense: | 3'- AGGGCAAACAUCUACUGUU |  |
| NFE2L2_3 | Sense: | 5'- UCCCGUUUGUAGAUGAC^A^A | 5% |
|  | Antisense: | 3'- AGGGCAAACAUCUACUGUU |  |
| NFE2L2_3 | Sense: | 5'- U C CCGUUUGUAGAUGACAA | 22% |
|  | Antisense: | 3'- AGGGCAAACAUCUACUGUU |  |

TABLE H3-continued

All modifications preformed on the NFE2L2_3 molecule ( Sen: SEQ ID
NO: 8497; AS: SEQ ID NO: 8506). Sense strand is 5'-3'orientation;
Antisense strand is 3'-5' orientation.
The molecules in Table H3 were modified as following:
Bold: 2-O-methyl sugar modified ribonucleotide
<u>underlined</u>: ENA (2'-O,4'-C-Ethylene-bridged nucleotide)
small case: L-DNA
\*: 2'-5' internucleosidelinkage; 3'p: phosphate in the 3' end; ^: PACE linkage.
Table H3.

| SiRNA number and ID | Description of modifications | | Residual activity in vitro at 20nM (% of control) |
|---|---|---|---|
| NFE2L2_3 | Sense: | 5'- U C CCGUUUGUAGAUGAC^A^A | 8% |
| | Antisense: | 3'- AGGGCAAACAUCUACUGUU | |
| NFE2L2_3 | Sense: | 5'- U^C^CCGUUUGUAGAUGAC^AA | 7% |
| | Antisense: | 3'- AGGGCAAACAUCUACUGUU | |
| NFE2L2_3 | Sense: | 5'- U^C^CCGUUUGUAGAUGACA^A | 9% |
| | Antisense: | 3'- AGGGCAAACAUCUACUGUU | |
| NFE2L2_3 | Sense: | 5'- U^C^CCGUUUGUAGAUGAC^AA | 7% |
| | Antisense: | 3'- AGGGCAAACAUCUACUGUU | |
| NFE2L2_3 | Sense: | 5'- UCCCGUUUGUAGAUGAC^A^A | 15% |
| | Antisense: | 3'- A^G^GGCAAACAUCUACUGUU | |
| NFE2L2_3 | Sense: | 5'- U^C^CCGUUUGUAGAUGACAA | 16% |
| | Antisense: | 3'- A^G^GGCAAACAUCUACUGUU | |
| NFE2L2_3 | Sense: | 5'- U^C^CCGUUUGUAGAUGAC^A^A | 49% |
| | Antisense: | 3'- A^G^GGCAAACAUCUACUGUU | |
| NFE2L2_3 | Sense: | 5'- U^C^CCGUUUGUAGAUGA^C^AA | 25% |
| | Antisense: | 3'- A^G^GGCAAACAUCUACUGUU | |
| NFE2L2_3 | Sense: | 5'- UCCCGUUUGUAGAUGACA^A | 49% |
| | Antisense: | 3'- A^G^GGCAAACAUCUACUGUU | |
| NFE2L2_3 | Sense: | 5'- UCCCGUUUGUAGAUGAC^AA | 49% |
| | Antisense: | 3'- A^G^GGCAAACAUCUACUGUU | |

: 2-O-methyl alternating structure in the antisense strand

TABLE H4

All modifications preformed with the NFE2L2_14 (Sense: SEQ ID NO: 8509;
Antisense: SEQ ID NO: 8522) and NFE2L2_16 molecules (Sense: SEQ Id NO: 8510;
Antisense: SEQ ID NO: 8523).
Sense strand is 5'-3'orientation; Antisense strand is 3'-5' orientation.
The molecules in Table H4 were modified as following:
Bold: 2-O-methyl sugarmofdified ribonucleotide:
subscript: DNA nucleotide; small case: L-DNA
Table H4:

| SiRNA number and ID | Description of modifications | | Residual activity in vitro at 20nM (% of control) |
|---|---|---|---|
| NFE2L2_14 | Sense: | 5'- CCUGGAAGUGUCAAACagA | 8% |
| | Antisense: | 3'- GGACCUUCACAGUUUGUCU | |
| NFE2L2_14 | Sense: | 5'- CCUGGAAGUGUCAAACagA | 23% |
| | Antisense: | 3'- GGACCUUCACAGUUUGUCU | |
| NFE2L2_16 | Sense: | 5'- GGGCAAAAGCUCUCcAuaU | 20% |
| | Antisense: | 3'- CCCGUUUUCGAGAGGUAUA | |
| NFE2L2_16 | Sense: | 5'- GGGCAAAACCUCUCcAuaU | 41% |
| | Antisense: | 3'- CCCGUUUUCGAGAGGUAUA | |

: 2-O-methyl alternating structure in the antisense strand

The molecules in Table H5 NFE2L2_3 (Sense: SEQ ID NO: 8497; Antisense: SEQ ID NO: 8506). NFE2L2_14 (Sense: SEQ ID NO: 8509; Antisense: SEQ ID NO: 8522) and NFE2L2_16 (Sense: SEQ ID NO: 8510; Antisense: SEQ ID NO: 8523) were modified according to the key below:

| Modification Code | Modification Name |
|---|---|
| $ | No 3' Phosphate |
| m | 2'OMe-3'-Pi |
| Ld | L-DNA-3'-Pi |
| ena | ENA-3'-Pi |
| dNpac | PACE |

-continued

| Modification Code | Modification Name |
|---|---|
| d | DNA-3'-Pi |
| iB | inverted-deoxy-Abasic |
| c6Np | Amino-C6-Pi |
| r | ribonucleotide |

TABLE 5

| SiRNA Number | Sense (5' > 3') | AntiSense (5' > 3') | % Residual Activity at 20 nM |
|---|---|---|---|
| NFE2L2__ | rU; rC; rC; rC; rG; rU; rU; rU; rG; rU; rA; rG; rA; rU; rG; rA; rC; LdA; LdA$ | rU; rU; rG; rU; rC; rA; rU; rC; rU; rA; rC; rA; rA; rA; rC; rG; rG; rG; LdA$ | 8 |
| NFE2L2__3 | rU; rC; rC; rC; rG; rU; rU; rU; rG; rU; rA; rG; rA; rU; rG; rA; rC2p; rA2p; rA$ | mU; rU; mG; rU; mC; rA; mU; rC; mU; rA; mC; rA; mA; rA; mC; rG; mG; rG; mA$ | 12 |
| NFE2L2__3 | rU; rC; rC; rC; rG; rU; rU; rU; rG; rU; rA; rG; rA; rU; rG; rA; rC2p; rA2p; rA | mU; rU; mG; rU; mC; rA; mU; rC; mU; rA; mC; rA; mA; rA; mC; rG; mG; rG; mA$ | 15 |
| NFE2L2__3 | rU; rC; rC; rC; rG; rU; rU; rU; rG; rU; rA; rG; rA; rU; rG; rA; rC; LdA; LdA | mU; rU; mG; rU; mC; rA; mU; rC; mU; rA; mC; rA; mA; rA; mC; rG; mG; rG; mA$ | 13 |
| NFE2L2__3 | rU; rC; rC; rC; rG; rU; rU; rU; rG; rU; rA; rG; rA; rU; rG; rA; rC; LdA; LdA$ | mU; rU; mG; rU; mC; rA; mU; rC; mU; rA; mC; rA; mA; rA; mC; rG; mG; rG; mA$ | 9 |
| NFE2L2__3 | mU; mC; mC; mC; mG; rU; rU; rU; rG; rU; rA; rG; rA; rU; rG; rA; rC; LdA; LdA | mU; rU; mG; rU; mC; rA; mU; rC; mU; rA; mC; rA; mA; rA; mC; rG; mG; rG; mA$ | 13 |
| NFE2L2__3 | mU; mC; mC; mC; mG; rU; rU; rU; rG; rU; rA; rG; rA; rU; rG; rA; rC; LdA; LdA$ | mU; rU; mG; rU; mC; rA; mU; rC; mU; rA; mC; rA; mA; rA; mC; rG; mG; rG; mA$ | 21 |
| NFE2L2__3 | rU; rC; rC; rC; rG; rU; rU; rU; rG; rU; rA; rG; rA; rU; rG; rA; dCpac; dApac; rA$ | mU; rU; mG; rU; mC; rA; mU; rC; mU; rA; mC; rA; mA; rA; mC; rG; mG; rG; mA$ | 5 |
| NFE2L2__3 | dUpac; dCpac; rC; rC; rG; rU; rU; rU; rG; rU; rA; rG; rA; rU; rG; rA; rC; rA; rA$ | mU; rU; mG; rU; mC; rA; mU; rC; mU; rA; mC; rA; mA; rA; mC; rG; mG; rG; mA$ | 22 |
| NFE2L2__3 | dUpac; dCpac; rC; rC; rG; rU; rU; rU; rG; rU; rA; rG; rA; rU; rG; rA; dCpac; dApac; rA$ | mU; rU; mG; rU; mC; rA; mU; rC; mU; rA; mC; rA; mA; rA; mC; rG; mG; rG; mA$ | 8 |
| NFE2L2__3 | rU; rC; rC; rC; rG; rU; rU; rU; rG; rU; rA; rG; rA; rU; rG; dApac; dCpac; rA; rA$ | mU; rU; mG; rU; mC; rA; mU; rC; mU; rA; mC; rA; mA; rA; mC; rG; mG; rG; mA$ | 7 |
| NFE2L2__3 | rU; rC; rC; rC; rG; rU; rU; rU; rG; rU; rA; rG; rA; rU; rG; rA; rC; dApac; rA$ | mU; rU; mG; rU; mC; rA; mU; rC; mU; rA; mC; rA; mA; rA; mC; rG; mG; rG; mA$ | 9 |
| NFE2L2__3 | rU; rC; rC; rC; rG; rU; rU; rU; rG; rU; rA; rG; rA; rU; rG; rA; dCpac; rA; rA$ | mU; rU; mG; rU; mC; rA; mU; rC; mU; rA; mC; rA; mA; rA; mC; rG; mG; rG; mA$ | 7 |
| NFE2L2__3 | rU; rC; rC; rC; rG; rU; rU; rU; rG; rU; rA; rG; rA; rU; rG; rA; dCpac; dApac; rA$ | rU; rU; rG; rU; rC; rA; rU; rC; rU; rA; rC; rA; rA; rA; rC; rG; dGpac; dGpac; rA$ | 15 |
| NFE2L2__3 | dUpac; dCpac; rC; rC; rG; rU; rU; rU; rG; rU; rA; rG; rA; rU; rG; rA; rC; rA; rA$ | rU; rU; rG; rU; rC; rA; rU; rC; rU; rA; rC; rA; rA; rA; rC; rG; dGpac; dGpac; rA$ | 16 |
| NFE2L2__3 | dUpac; dCpac; rC; rC; rG; rU; rU; rU; rG; rU; rA; rG; rA; rU; rG; rA; dCpac; dApac; rA$ | rU; rU; rG; rU; rC; rA; rU; rC; rU; rA; rC; rA; rA; rA; rC; rG; dGpac; dGpac; rA$ | 49 |
| NFE2L2__3 | rU; rC; rC; rC; rG; rU; rU; rU; rG; rU; rA; rG; rA; rU; rG; dApac; dCpac; rA; rA$ | rU; rU; rG; rU; rC; rA; rU; rC; rU; rA; rC; rA; rA; rA; rC; rG; dGpac; dGpac; rA$ | 25 |
| NFE2L2__3 | rU; rC; rC; rC; rG; rU; rU; rU; rG; rU; rA; rG; rA; rU; rG; rA; rC; dApac; rA$ | rU; rU; rG; rU; rC; rA; rU; rC; rU; rA; rC; rA; rA; rA; rC; rG; dGpac; dGpac; rA$ | 49 |
| NFE2L2__3 | rU; rC; rC; rC; rG; rU; rU; rU; rG; rU; rA; rG; rA; rU; rG; rA; dCpac; rA; rA$ | rU; rU; rG; rU; rC; rA; rU; rC; rU; rA; rC; rA; rA; rA; rC; rG; dGpac; dGpac; rA$ | 49 |
| NFE2L2__3 | enaT; rC; rC; rC; rG; rU; rU; rU; rG; rU; rA; rG; rA; rU; rG; rA; rC; rA; rA$ | mU; rU; mG; rU; mC; rA; mU; rC; mU; rA; mC; rA; mA; rA; mC; rG; mG; rG; mA$ | 30 |

TABLE 5-continued

| SiRNA Number | Sense (5' > 3') | AntiSense (5' > 3') | % Residual Activity at 20 nM |
|---|---|---|---|
| NFE2L2_3 | enaT; enaC; rC; rC; rG; rU; rU; rU; rG; rU; rA; rG; rA; rU; rG; rA; rC; rA; rA$ | mU; rU; mG; rU; mC; rA; mU; rC; mU; rA; mC; rA; mA; rA; mC; rG; mG; rG; mA$ | 36 |
| NFE2L2_3 | enaT; enaC; enaC; rC; rG; rU; rU; rU; rG; rU; rA; rG; rA; rU; rG; rA; rC; rA; rA$ | mU; rU; mG; rU; mC; rA; mU; rC; mU; rA; mC; rA; mA; rA; mC; rG; mG; rG; mA$ | 45 |
| NFE2L2_3 | enaT; enaC; enaC; rC; rG; rU; rU; rU; rG; rU; rA; rG; rA; rU; rG; rA; rC; LdA; LdA$ | mU; rU; mG; rU; mC; rA; mU; rC; mU; rA; mC; rA; mA; rA; mC; rG; mG; rG; mA$ | 6 |
| NFE2L2_3 | enaT; enaC; enaC; rC; rG; rU; rU; rU; rG; rU; rA; rG; rA; rU; rG; rA; LdC; LdA; rA$ | mU; rU; mG; rU; mC; rA; mU; rC; mU; rA; mC; rA; mA; rA; mC; rG; mG; rG; mA$ | 24 |
| NFE2L2_3 | enaT; enaC; enaC; rC; rG; rU; rU; rU; rG; rU; rA; rG; rA; rU; rG; rA; rC2p; rA2p; rA$ | mU; rU; mG; rU; mC; rA; mU; rC; mU; rA; mC; rA; mA; rA; mC; rG; mG; rG; mA$ | 11 |
| NFE2L2_3 | enaT; enaC; rC; rG; rU; rU; rU; rG; rU; rA; rG; rA; rU; rG; rA2p; rC2p; rA; rA$ | mU; rU; mG; rU; mC; rA; mU; rC; mU; rA; mC; rA; mA; rA; mC; rG; mG; rG; mA$ | 31 |
| NFE2L2_3 | enaT; rC; rC; rC; rG; rU; rU; rU; rG; rU; rA; rG; rA; rU; rG; rA; rC; rA; rA$ | rU; rU; rG; rU; rC; rA; rU; rC; rU; rA; rC; rA; rA; rA; rC; rG; enaG; enaG; enaA$ | 41 |
| NFE2L2_3 | enaT; enaC; rC; rC; rG; rU; rU; rU; rG; rU; rA; rG; rA; rU; rG; rA; rC; rA; rA$ | rU; rU; rG; rU; rC; rA; rU; rC; rU; rA; rC; rA; rA; rA; rC; rG; enaG; enaG; enaA$ | 35 |
| NFE2L2_3 | enaT; enaC; enaC; rC; rG; rU; rU; rU; rG; rU; rA; rG; rA; rU; rG; rA; rC; rA; rA$ | rU; rU; rG; rU; rC; rA; rU; rC; rU; rA; rC; rA; rA; rA; rC; rG; enaG; enaG; enaA$ | 50 |
| NFE2L2_3 | enaT; enaC; enaC; rC; rG; rU; rU; rU; rG; rU; rA; rG; rA; rU; rG; rA; rC; LdA; LdA$ | rU; rU; rG; rU; rC; rA; rU; rC; rU; rA; rC; rA; rA; rA; rC; rG; enaG; enaG; enaA$ | 32 |
| NFE2L2_3 | enaT; enaC; enaC; rC; rG; rU; rU; rU; rG; rU; rA; rG; rA; rU; rG; rA; LdC; LdA; rA$ | rU; rU; rG; rU; rC; rA; rU; rC; rU; rA; rC; rA; rA; rA; rC; rG; enaG; enaG; enaA$ | 49 |
| NFE2L2_3 | enaT; enaC; enaC; rC; rG; rU; rU; rU; rG; rU; rA; rG; rA; rU; rG; rA; rC2p; rA2p; rA$ | rU; rU; rG; rU; rC; rA; rU; rC; rU; rA; rC; rA; rA; rA; rC; rG; enaG; enaG; enaA$ | 38 |
| NFE2L2_3 | enaT; enaC; rC; rG; rU; rU; rU; rG; rU; rA; rG; rA; rU; rG; rA2p; rC2p; rA; rA$ | rU; rU; rG; rU; rC; rA; rU; rC; rU; rA; rC; rA; rA; rA; rC; rG; enaG; enaG; enaA$ | 58 |
| NFE2L2_14 | rC; rC; rU; rG; rG; rA; rA; rG; rU; rG; rU; rC; rA; rA; dA; rC; rA; LdG; rA$ | mU; rC; mU; rG; mU; rU; mU; rG; mA; rC; mA; rC; mU; rU; mC; rC; mA; rG; mG$ | 9; 17 (5 nM) |
| NFE2L2_14 | rC; rC; rU; rG; rG; rA; rA; rG; rU; rG; rU; rC; rA; rA; dA; rC; LdG; LdG; rA$ | mU; rC; mU; rG; mU; rU; mU; rG; mA; rC; mA; rC; mU; rU; mC; rC; mA; rG; mG$ | 23; 22 (5 nM) |
| NFE2L2_16 | rG; rG; rG; rC; rA; rA; rA; rA; rG; rC; rU; rC; rU; rC; dC; rA; rU; LdA; rU$ | mA; rU; mA; rU; mG; rG; mA; rG; mA; rG; mC; rU; mU; rU; mU; rG; mC; rC; mC$ | 20; 16 (5 nM) |
| NFE2L2_16 | rG; rG; rG; rC; rA; rA; rA; rA; rG; rC; rU; rC; rU; rC; dC; rA; Ld; LdA; rU$ | mA; rU; mA; rU; mG; rG; mA; rG; mA; rG; mC; rU; mU; rU; mU; rG; mC; rC; mC$ | 41; 47 (5 nM) |
| NFE2L2_14 | dC; mC; dT; mG; dG; mA; dA; mG; dT; mG; dT; mC; dA; mA; dA; mC; dA; mG; dA$ | mU; dC; mU; dG; mU; dT; mU; dG; mA; rC; mA; dC; mU; dT; mC; dC; mA; dG; mG$ | 84 |
| NFE2L2_14 | dC; mC; dT; mG; dG; mA; dA; mG; dT; mG; dT; dC; mA; dA; mA; dC; mA; dG; mA$ | dT; mC; dT; mG; dT; mU; dT; mG; rA; rC; mA; dC; mU; dT; mC; dC; mA; dG; mG$ | 43 |
| NFE2L2_14 | rC; LdC; rU; rG; rG; rA; rA; rG; rU; rG; rU; rC; rA; rA; rA; rC; rA; LdG; rA$ | mU; rC; mU; rG; mU; rU; mU; rG; mA; rC; mA; rC; mU; rU; mC; rC; mA; rG; mG$ | |
| NFE2L2_14 | iB; rC; rC; rU; rG; rG; rA; rA; rG; rU; rG; rU; rC; rA; rA; rA; rC; rA; LdG; rA$ | mU; rC; mU; rG; mU; rU; mU; rG; mA; rC; mA; rC; mU; rU; mC; rC; mA; rG; mG$ | |
| NFE2L2_14 | rC; LdC; rU; rG; rG; rA; rA; rG; rU; rG; rU; rC; rA; rA; rA; rC; rA; LdG; rA$; | rU; mC; rU; mG; rU; mU; rU; mG; rA; rC; mA; rC; mU; rU; mC; rC; mA; rG; mG$ | |
| NFE2L2_14 | rC; LdC; rU; rG; rG; rA; rA; rG; rU; rG; rU; rC; rA; rA; rA; rC; rA; LdG; rA$ | mU; mC; mU; rG; mU; rU; mU; rG; mA; mA; rC; mU; rU; mC; rC; mA; rG; mG$ | |
| NFE2L2_14 | rC; rC; rU; rG; rG; rA; rA; rG; rU; rG; rU; rC; rA; rA; rA; rC; rA; LdG; rA$ | mU; mC; mU; rG; mU; rU; mU; rG; mA; rC; mA; rC; mU; rU; mC; rC; mA; rG; mG$ | |
| NFE2L2_14 | rC; rC; rU; rG; rG; rA; rA; rG; rU; rG; rU; rC; rA; rA; rA; rC; rA; LdG; rA$ | mU; mC; mU; rG; mU; rU; mU; rG; mA; rC; mA; rC; mU; rU; mC; rC; mA; rG; mG$ | |

TABLE 5-continued

| SiRNA Number | Sense (5' > 3') | AntiSense (5' > 3') | % Residual Activity at 20 nM |
|---|---|---|---|
| NFE2L2__14 | rC; rC; rU; rG; rG; rA; rA; rG; rU; rG; rU; rC; rA; rA; rA; rC; rA; LdG; rA$; | rU; mC; rU; mG; rU; mU; rU; mG; rA; rC; mA; rC; mU; rU; mC; rC; mA; rG; mG$ | |
| NFE2L2__14 | iB; rC; rC; rU; rG; rG; rA; rA; rG; rU; rG; rU; rC; rA; rA; rA; rC; rA; LdG; rA$ | rU; mC; rU; mG; rU; mU; rU; mG; rA; rC; mA; rC; mU; rU; mC; rC; mA; rG; mG$ | |
| NFE2L2__14 | iB; rC; rC; rU; rG; rG; rA; rA; rG; rU; rG; rU; rC; rA; rA; rA; rC; rA; LdG; rA$ | mU; mC; mU; rG; mU; mU; rG; mA; rC; mA; rC; mU; rU; mC; rC; mA; rG; mG$ | |
| NFE2L2__14 | c6Np; rC; rC; rU; rG; rG; rA; rA; rG; rU; rG; rU; rC; rA; rA; rA; rC; rA; LdG; rA$ | mU; rC; mU; rG; mU; rU; mU; rG; mA; rC; mA; rC; mU; rU; mC; rC; mA; rG; mG$ | |
| NFE2L2__14 | c6Np; rC; rC; rU; rG; rG; rA; rA; rG; rU; rG; rU; rC; rA; rA; rA; rC; rA; LdG; rA$ | mU; mC; mU; rG; mU; rU; mU; rG; mA; rC; mA; rC; mU; rU; mC; rC; mA; rG; mG$ | |
| NFE2L2__14 | c6Np; rC; rC; rU; rG; rG; rA; rA; rG; rU; rG; rU; rC; rA; rA; rA; rC; rA; LdG; rA$ | rU; mC; rU; mG; rU; mU; rU; mG; rA; rC; mA; rC; mU; rU; mC; rC; mA; rG; mG$ | |

Example 3

The Effect of Nrf2 siRNA Treatment on Tumor Growth in Vivo Methods (a) Subcutaneous tumor xenografts: A549 cells ($5\times10^6$) are injected into the hind leg of male athymic nude mice and the subcutaneous tumor is measured weekly. The tumor volumes are measured using the following formula: [length (mm)× width (mm)×width (mm)×0.52]. For in vivo delivery of siRNA into subcutaneous tumors, siRNA duplexes diluted in PBS are injected into the hind leg tumors using insulin syringes at a concentration of 10 μg/ml. Intraperitoneal injections of carboplatin are given at a dose of 40 mg/kg body weight. Both siRNA and carboplatin are administered twice weekly for 4 weeks. In order to test the anti-tumor activity of Nrf2 siRNA in vivo, mice bearing subcutaneous tumors are treated with Nrf2 siRNA by direct injection into the tumor and by carboplatin twice a week for 4 weeks and tumor weight is measured at the termination of the experiment.

(b) Lung metastasis experiments: $2\times10^6$ A549-C8-luc cells are injected into SCID-Beige mice (Charles River, Mass.) intravenously and the lung tumor is measured weekly. For aerosol delivery of Nrf2 or GFP siRNA into lung tumors, 100 μg of siRNA duplex diluted in PBS is aerosolized using a nebulizer. Mice are given three dose of siRNA (100 μg/dose) every week, for 4 weeks, using a nebulizer. Intraperitoneal injections of carboplatin are given at a dose of 30 mg/kg body weight twice/week. Tumor weight is measured at the termination of the experiment.

siRNA according to Tables A-H, and in particular to siRNA disclosed in Tables H1-H5 are tested in this animal model, which show that these siRNA compounds may treat and/or prevent lung cancer.

SEQUENCE LISTING (8533 sequences)

SEQ ID NO: 1 - DNA, 2884 bp, Homo sapiens
aaaucagggaggcgcagcuccuacaccaacgccuuuccggggcuccggguguguuuguuccaacuguuuaaacuguuucaaagcguccgaacuccagcgaccuucgcaaacaacucuuuaucucgcgggcgagagcgcugcccuuauuugcgggggagggcaaacugaacgccggcaccggggagcuaacggagaccuccucuaggucccccgccugcugggaccccagcuggcagucccuucccgcccccggaccgcgagcuucuugcgucagccccggcgcgggugggggauuuucggaagcucagcccgcgcggccggcgggggaaggaagggcccggacucuugccccgcccuuguggggcgggaggcggagcggggcaggggcccgccggcguguagccgauuaccgagugccggggagcccggaggagccgccgacgcagccgccaccgccgccgccgccgccaccagagccgcccuguccgcgccgcgccucggcagccggaacagggccgccgucggggagccccaacacacgguccacagcucaucaugauggacuuggagcugccgccgccgggacucccgucccagcaggacauggauuugauugacauacuuuggaggcaagauauagaucuuggaguaagucgagaaguauuugacuucagucagcgacggaaagaguaugagcuggaaaaacagaaaaaacuugaaaaggaaagacaagaacaacuccaaaaggagcaagagaaagccuuuuucgcucaguuacaacuagaugaagagacaggugaauuucucccaauucagccagcccagcacauccagucagaaaccaguggaucugccaacuacucccagguugcccacauucccaaaucagaugcuuuguacuuugaugacugcaugcagcuuuuggcgcagacauucccguuuguagaugacaaugagguuucuucggcuacguuucagucacuuguuccugauauucccggucacaucgagagcccagucuucauugcuacuaaucaggcucagucaccugaaacuucuguugcucagguagccccuguugauuuagacgguaugcaacaggacauugagcaaguuugggaggagcuauuauccauuccugaguuacagugucuuaauauugaaaaugacaagcugguugagacuaccaugguuccaaguccagaagccaaacugacagaaguugacaauuaucauuuuuacucaucuauacccucaauggaaaaagaaguagguaacuguaguccacauuuucuuaaugcuuuugaggauuccuucagcagcauccucuccacagaagaccccaaccaguugacagugaacucauuaaauucagaugccacagucaacacagauuuuggugaugaauuuuauucugcuuucauagcugagcccaguaucagcaacagcaugcccucaccugcuacuuuaagccauucacucucugaacuucuaaaugggcccauugauguuucugaucuaucacuuugcaaagcuuucaaccaaaaccacccugaaagcacagcagaauucaaugauucugacuccggcauuucacuaaacacaagucccaguguggcaucaccagaacacucaguggaaucuuccagcuauggagacacacuacuuggccucagugauucugaaguggaagagcuagauagugccccuggaagugucaaacagaaugguccuaaaacaccaguacauucuucuggggauaugguacaacccuugucaccaucucaggggcagagcacucacgugcaugaugcccaaugugagaacacaccagagaaagaauugccuguaaguccuggucaucggaaaaccccauucacaaaagacaaacauucaagccgcuuggaggcucaucucacaagagaugaacuuagggcaaaagcucuccauaucccauucccuguagaaaaaaucauuaaccucccuguuguugacuucaacgaaaugauguccaaagagcaguucaaugaagcucaacuugcauuaauucgggauauacguaggagggguaagaauaaaguggcugcucagaauugcagaaaaagaaaacuggaaaauauaguagaacuagagcaagauuuagaucauuugaaagaugaaaaagaaaaauugcucaaagaaaaaggagaaaaugacaaaagccuucaccuacugaaaaaacaacucagcaccuuauaucucgaaguuuucagcaugcuacgugaugaagauggaaaaccuuauucuccuagugaauacucccugcagcaaacaagagauggcaauguuuuccuuguucccaaaaguaagaagccagauguuaagaaaaacuagauuuaggaggauuugaccuuuucugagcuaguuuuuuuguacuauuauacuaaaagcuccuacugugaugugaaaugcucauacuuuauaaguaauucuaugcaaaaucauagccaaaacuaguauagaaaauaauacgaaacuuuaaaaagcauuggagugucaguauguugaaucaguaguuucacuuuaacuguaaacaauuucuuaggacaccauuugggcuaguuucuguguaaguguaaauacuacaaaaacuuauuuauacuguucuuaugucauuuguuauauucauagauuuauaugaugauaugacaucuggcuaaaaagaaauuauugcaaaacuaaccacuauguacuuuuuuauaaauacuguauggacaaaaaauggcauuuuuuauauuaaauuguuuagcucuggcaaaaaaaaaaaauuuuaagagcugguacuaauaaaggauuauuaugacuguuaaauuaaaaaaaaaaaaaaaaaaaaaaaaaaaaaaaa

SEQ ID NO: 2 - RNA, 2771 nt, Homo sapiens
aagcccagccccgggacgagggaggagcgccuuaagugcccagcgggcucagaagccccgacguguggcggcugagccgggccccgcgcacuuucucggccggggagggguucgggcucgggcacccggaguuggccccucguaacgccgcgggaaagugcgggcgagggcaguggacucugaggccggagucggcggcacccggggcuucuaguucggacgcggugcccccugguggcgcucaccgcgcgcguggccuuggcuuccgugacagcgcucgguuggccgucacagcagcccucgguuggcccuuuccugcuuuauagcgugcaaaccucgccgcgccagggccaagggacagguuggagcuguugaucuguugcgcaauugcuauuuuccccagagcggcuuugucuuuggauuuagcguuucagaauugcaauuccaaaauguguaagacgggauauucucuucugugcugucaagggacauggauuugauugacauacuuuggaggcaagauauagaucuuggaguaagucgagaaguauuugacuucagucagcgacggaaagaguaugagcuggaaaaacagaaaaaacuugaaaaggaaagacaagaacaacuccaaaaggagcaagagaaagccuuuuucgcucaguuacaacuagaugaagagacaggugaauuucucccaauucagccagcccagcacauccagucagaaaccaguggaucugccaacuacucccagguugcccacauucccaaaucagaugcuuuguacuuugaugacugcaugcagcuuuuggcgcagacauucccguuuguagaugacaaugagguuucuucggcuacguuucagucacuuguuccugauauucccggucacaucgagagcccagucuucauugcuacuaaucaggcucagucaccugaaacuucuguugcucagguagccccuguugauuuagacgguaugcaacaggacauugagcaaguuugggaggagcuauuauccauuccugaguuacagugucuuaauauugaaaaugacaagcugguugagacuaccaugguuccaaguccagaagccaaacugacagaaguugacaauuaucauuuuuacucaucuauacccucaauggaaaaagaaguagguaacuguaguccacauuuucuuaaugcuuuugaggauuccuucagcagcauccucuccacagaagaccccaaccaguugacagugaacucauuaaauucagaugccacagucaacacagauuuuggugaugaauuuuauucugcuuucauagcugagcccaguaucagcaacagcaugcccucaccugcuacuuuaagccauucacucucugaacuucuaaaugggcccauugauguuucugaucuaucacuuugcaaagcuuucaaccaaaaccacccugaaagcacagcagaauucaaugauucugacuccggcauuucacuaaacacaagucccaguguggcaucaccagaacacucaguggaaucuuccagcuauggagacacacuacuuggccucagugauucugaaguggaagagcuagauagugccccuggaagugucaaacagaaugguccuaaaacaccaguacauucuucuggggauaugguacaacccuugucaccaucucaggggcagagcacucacgugcaugaugcccaaugugagaacacaccagagaaagaauugccuguaaguccuggucaucggaaaaccccauucacaaaagacaaacauucaagccgcuuggaggcucaucucacaagagaugaacuuagggcaaaagcucuccauaucccauucccuguagaaaaaaucauuaaccucccuguuguugacuucaacgaaaugauguccaaagagcaguucaaugaagcucaacuugcauuaauucgggauauacguaggagggguaagaauaaaguggcugcucagaauugcagaaaaagaaaacuggaaaauauaguagaacuagagcaagauuuagaucauuugaaagaugaaaaagaaaaauugcucaaagaaaaaggagaaaaugacaaaagccuucaccuacugaaaaaacaacucagcaccuuauaucucgaaguuuucagcaugcuacgugaugaagauggaaaaccuuauucuccuagugaauacucccugcagcaaacaagagauggcaauguuuuccuuguucccaaaaguaagaagccagauguuaagaaaaacuagauuuaggaggauuugaccuuuucugagcuaguuuuuuuguacuauuauacuaaaagcuccuacugugaugugaaaugcucauacuuuauaaguaauucuaugcaaaaucauagccaaaacuaguauagaaaauaauacgaaacuuuaaaaagcauuggagugucaguauguugaaucaguaguuucacuuuaacuguaaacaauuucuuaggacaccauuugggcuaguuucuguguaaguguaaauacuacaaaaacuuauuuauacuguucuuaugucauuuguuauauucauagauuuauaugaugauaugacaucuggcuaaaaagaaauuauugcaaaacuaaccacuauguacuuuuuuauaaauacuguauggacaaaaaauggcauuuuuuauauuaaauuguuuagcucuggcaaaaaaaaaaaauuuuaagagcugguacuaauaaaggauuauuaugacuguuaaauuaaaaaaaaaaaaaaaaaaaaaaaaaaaaaaaa

SEQ ID NO: 3 - RNA, 2750 nt, Homo sapiens
aagcccagccccgggacgagggaggagcgccuuaagugcccagcgggcucagaagccccgacguguggcggcugagccgggccccgcgcacuuucucggccggggagggguucgggcucgggcacccggaguuggccccucguaacgccgcgggaaagugcgggcgagggcaguggacucugaggccggagucggcggcacccggggcuucuaguucggacgcggugcccccugguggcgcucaccgcgcgcguggccuuggcuuccgugacagcgcucgguuggccgucacagcagcccucgguuggcccuuuccugcuuuauagcgugcaaaccucgccgcgccagggccaagggacagguuggagcuguugaucuguugcgcaauugcuauuuuccccagagcggcuuugucuuuggauuuagcguuucagaauugcaauuccaaaauguguaagacgggauauucucuucugugcugucaagggacauggauuugauugacauacuuuggaggcaagauauagaucuuggaguaagucgagaaguauuugacuucagucagcgacggaaagaguaugagcuggaaaaacagaaaaaacuugaaaaggaaagacaagaacaacuccaaaaggagcaagagaaagccuuuuucgcucaguuacaacuagaugaagagacaggugaauuucucccaauucagccagcccagcacauccagucagaaaccaguggaucugccaacuacucccagguugcccacauucccaaaucagaugcuuuguacuuugaugacugcaugcagcuuuuggcgcagacauucccguuuguagaugacaaugagucacuuguuccugauauucccggucacaucgagagcccagucuucauugcuacuaaucaggcucagucaccugaaacuucuguugcucagguagccccuguugauuuagacgguaugcaacaggacauugagcaaguuugggaggagcuauuauccauuccugaguuacagugucuuaauauugaaaaugacaagcugguugagacuaccaugguuccaaguccagaagccaaacugacagaaguugacaauuaucauuuuuacucaucuauacccucaauggaaaaagaaguagguaacuguaguccacauuuucuuaaugcuuuugaggauuccuucagcagcauccucuccacagaagaccccaaccaguugacagugaacucauuaaauucagaugccacagucaacacagauuuuggugaugaauuuuauucugcuuucauagcugagcccaguaucagcaacagcaugcccucaccugcuacuuuaagccauucacucucugaacuucuaaaugggcccauugauguuucugaucuaucacuuugcaaagcuuucaaccaaaaccacccugaaagcacagcagaauucaaugauucugacuccggcauuucacuaaacacaagucccaguguggcaucaccagaacacucaguggaaucuuccagcuauggagacacacuacuuggccucagugauucugaaguggaagagcuagauagugccccuggaagugucaaacagaaugguccuaaaacaccaguacauucuucuggggauaugguacaacccuugucaccaucucaggggcagagcacucacgugcaugaugcccaaugugagaacacaccagagaaagaauugccuguaaguccuggucaucggaaaaccccauucacaaaagacaaacauucaagccgcuuggaggcucaucucacaagagaugaacuuagggcaaaagcucuccauaucccauucccuguagaaaaaaucauuaaccucccuguuguugacuucaacgaaaugauguccaaagagcaguucaaugaagcucaacuugcauuaauucgggauauacguaggagggguaagaauaaaguggcugcucagaauugcagaaaaagaaaacuggaaaauauaguagaacuagagcaagauuuagaucauuugaaagaugaaaaagaaaaauugcucaaagaaaaaggagaaaaugacaaaagccuucaccuacugaaaaaacaacucagcaccuuauaucucgaaguuuucagcaugcuacgugaugaagauggaaaaccuuauucuccuagugaauacucccugcagcaaacaagagauggcaauguuuuccuuguucccaaaaguaagaagccagauguuaagaaaaacuagauuuaggaggauuugaccuuuucugagcuaguuuuuuuguacuauuauacuaaaagcuccuacugugaugugaaaugcucauacuuuauaaguaauucuaugcaaaaucauagccaaaacuaguauagaaaauaauacgaaacuuuaaaaagcauuggagugucaguauguugaaucaguaguuucacuuuaacuguaaacaauuucuuaggacaccauuugggcuaguuucuguguaaguguaaauacuacaaaaacuuauuuauacuguucuuaugucauuuguuauauucauagauuuauaugaugauaugacaucuggcuaaaaagaaauuauugcaaaacuaaccacuauguacuuuuuuauaaauacuguauggacaaaaaauggcauuuuuuauauuaaauuguuuagcucuggcaaaaaaaaaaaauuuuaagagcugguacuaauaaaggauuauuaugacuguuaaauuaaaaaaaaaaaaaaaaaaaaaaaaaaaaaaaa

SEQ ID NO: 4 - RNA, 19 nt, artificial
  Completely synthesized
gggguaagaauaaaguggc

SEQ ID NO: 5 - RNA, 19 nt, artificial
  Completely synthesized
ggagggguaagaauaaagu

SEQ ID NO: 6 - RNA, 19 nt, artificial
  Completely synthesized
gcaaaacuaaccacuaugu

SEQ ID NO: 7 - RNA, 19 nt, artificial
  Completely synthesized
aaggagaaaaugacaaaag

SEQ ID NO: 8 - RNA, 19 nt, artificial
  Completely synthesized
cagaauugcagaaaaagaa

SEQ ID NO: 9 - RNA, 19 nt, artificial
  Completely synthesized
ggguaagaauaaaguggcu

SEQ ID NO: 10 - RNA, 19 nt, artificial
  Completely synthesized
gcccucaccugcuacuuua

SEQ ID NO: 11 - RNA, 19 nt, artificial
  Completely synthesized
agggguaagaauaaagugg

SEQ ID NO: 12 - RNA, 19 nt, artificial
  Completely synthesized
aggagggguaagaauaaag

SEQ ID NO: 13 - RNA, 19 nt, artificial
  Completely synthesized
ucccguuuguagaugacaa

SEQ ID NO: 14 - RNA, 19 nt, artificial
  Completely synthesized
aggagaaaaugacaaaagc

SEQ ID NO: 15 - RNA, 19 nt, artificial
  Completely synthesized
gcucagaauugcagaaaaa

SEQ ID NO: 16 - RNA, 19 nt, artificial
  Completely synthesized
gagaaagaauugccuguaa

SEQ ID NO: 17 - RNA, 19 nt, artificial
  Completely synthesized
uccggcauuucacuaaaca

SEQ ID NO: 18 - RNA, 19 nt, artificial
  Completely synthesized
gaguuacagugucuuaaua

SEQ ID NO: 19 - RNA, 19 nt, artificial
  Completely synthesized
gccaaaacuaguauagaaa

SEQ ID NO: 20 - RNA, 19 nt, artificial
  Completely synthesized
agccagauguuaagaaaaa

SEQ ID NO: 21 - RNA, 19 nt, artificial
  Completely synthesized
gaagccagauguuaagaaa

SEQ ID NO: 22 - RNA, 19 nt, artificial
  Completely synthesized
agaagccagauguuaagaa

SEQ ID NO: 23 - RNA, 19 nt, artificial
  Completely synthesized
ucagaauugcagaaaaaga

SEQ ID NO: 24 - RNA, 19 nt, artificial
  Completely synthesized
uaggagggguaagaauaaa

SEQ ID NO: 25 - RNA, 19 nt, artificial
  Completely synthesized
cacucucugaacuucuaaa

SEQ ID NO: 26 - RNA, 19 nt, artificial
  Completely synthesized
uagccccuguugauuuaga

SEQ ID NO: 27 - RNA, 19 nt, artificial
  Completely synthesized
gaucugccaacuacuccca

SEQ ID NO: 28 - RNA, 19 nt, artificial
  Completely synthesized
gcaaaaucauagccaaaac

SEQ ID NO: 29 - RNA, 19 nt, artificial
  Completely synthesized
guaagaagccagauguuaa

SEQ ID NO: 30 - RNA, 19 nt, artificial
  Completely synthesized
uaaaguggcugcucagaau

SEQ ID NO: 31 - RNA, 19 nt, artificial
  Completely synthesized
agaauaaaguggcugcuca

SEQ ID NO: 32 - RNA, 19 nt, artificial
  Completely synthesized
aggaaagacaagaacaacu

SEQ ID NO: 33 - RNA, 19 nt, artificial
  Completely synthesized
aaaggaaagacaagaacaa

SEQ ID NO: 34 - RNA, 19 nt, artificial
  Completely synthesized
aacuugaaaaggaaagaca

SEQ ID NO: 35 - RNA, 19 nt, artificial
  Completely synthesized
gacaaacauucaagccgcu

SEQ ID NO: 36 - RNA, 19 nt, artificial
  Completely synthesized
gacuccggcauuucacuaa

SEQ ID NO: 37 - RNA, 19 nt, artificial
  Completely synthesized
accaaaaccacccugaaag

SEQ ID NO: 38 - RNA, 19 nt, artificial
  Completely synthesized
acucucugaacuucuaaau

SEQ ID NO: 39 - RNA, 19 nt, artificial
  Completely synthesized
gacagugaacucauuaaau

SEQ ID NO: 40 - RNA, 19 nt, artificial
  Completely synthesized
aaguuugggaggagcuauu

SEQ ID NO: 41 - RNA, 19 nt, artificial
  Completely synthesized
uuguagaugacaaugaggu

SEQ ID NO: 42 - RNA, 19 nt, artificial
  Completely synthesized
aaacuaaccacuauguacu

SEQ ID NO: 43 - RNA, 19 nt, artificial
  Completely synthesized
caaaaucauagccaaaacu

SEQ ID NO: 44 - RNA, 19 nt, artificial
  Completely synthesized
uaagaagccagauguuaag

SEQ ID NO: 45 - RNA, 19 nt, artificial
  Completely synthesized
acgugaugaagauggaaaa

SEQ ID NO: 46 - RNA, 19 nt, artificial
  Completely synthesized
cuggaaaauauaguagaac

SEQ ID NO: 47 - RNA, 19 nt, artificial
  Completely synthesized
gaaaaggaaagacaagaac

SEQ ID NO: 48 - RNA, 19 nt, artificial
  Completely synthesized
ugaaaaggaaagacaagaa

SEQ ID NO: 49 - RNA, 19 nt, artificial
  Completely synthesized
uggagacacacuacuuggc

SEQ ID NO: 50 - RNA, 19 nt, artificial
  Completely synthesized
ucaaccaaaaccacccuga

SEQ ID NO: 51 - RNA, 19 nt, artificial
  Completely synthesized
cccucaccugcuacuuuaa

SEQ ID NO: 52 - RNA, 19 nt, artificial
  Completely synthesized
ugacagugaacucauuaaa

SEQ ID NO: 53 - RNA, 19 nt, artificial
  Completely synthesized
uuggaggcaagauauagau

SEQ ID NO: 54 - RNA, 19 nt, artificial
  Completely synthesized
gagcuauuauccauuccug

SEQ ID NO: 55 - RNA, 19 nt, artificial
  Completely synthesized
uagaugacaaugagguuuc

SEQ ID NO: 56 - RNA, 19 nt, artificial
  Completely synthesized
ugcccacauucccaaauca

SEQ ID NO: 57 - RNA, 19 nt, artificial
  Completely synthesized
agccaaaacuaguauagaa

SEQ ID NO: 58 - RNA, 19 nt, artificial
  Completely synthesized
aaaguaagaagccagaugu

SEQ ID NO: 59 - RNA, 19 nt, artificial
  Completely synthesized
ccaaaaguaagaagccaga

SEQ ID NO: 60 - RNA, 19 nt, artificial
  Completely synthesized
cccaaaaguaagaagccag

SEQ ID NO: 61 - RNA, 19 nt, artificial
  Completely synthesized
uacgugaugaagauggaaa

SEQ ID NO: 62 - RNA, 19 nt, artificial
  Completely synthesized
gcucaaagaaaaaggagaa

SEQ ID NO: 63 - RNA, 19 nt, artificial
  Completely synthesized
aacuagagcaagauuuaga

SEQ ID NO: 64 - RNA, 19 nt, artificial
  Completely synthesized
aaguggcugcucagaauug

SEQ ID NO: 65 - RNA, 19 nt, artificial
  Completely synthesized
guaggagggguaagaauaa

SEQ ID NO: 66 - RNA, 19 nt, artificial
  Completely synthesized
ucaacuugcauuaauucgg

SEQ ID NO: 67 - RNA, 19 nt, artificial
  Completely synthesized
aaagacaagaacaacucca

SEQ ID NO: 68 - RNA, 19 nt, artificial
  Completely synthesized
agaaagaauugccuguaag

SEQ ID NO: 69 - RNA, 19 nt, artificial
  Completely synthesized
acacaccagagaaagaauu

SEQ ID NO: 70 - RNA, 19 nt, artificial
  Completely synthesized
aacaccaguacauucuucu

SEQ ID NO: 71 - RNA, 19 nt, artificial
  Completely synthesized
aaacaccaguacauucuuc

SEQ ID NO: 72 - RNA, 19 nt, artificial
  Completely synthesized
acagaaugguccuaaaaca

SEQ ID NO: 73 - RNA, 19 nt, artificial
  Completely synthesized
aaaccacccugaaagcaca

SEQ ID NO: 74 - RNA, 19 nt, artificial
  Completely synthesized
aaccaaaaccacccugaaa

SEQ ID NO: 75 - RNA, 19 nt, artificial
  Completely synthesized
ucucugaacuucuaaaugg

SEQ ID NO: 76 - RNA, 19 nt, artificial
  Completely synthesized
uucacucucugaacuucua

SEQ ID NO: 77 - RNA, 19 nt, artificial
  Completely synthesized
guaguccacauuuucuuaa

SEQ ID NO: 78 - RNA, 19 nt, artificial
  Completely synthesized
uugaaaaugacaagcuggu

SEQ ID NO: 79 - RNA, 19 nt, artificial
  Completely synthesized
cagucuucauugcuacuaa

SEQ ID NO: 80 - RNA, 19 nt, artificial
  Completely synthesized
augacaaugagguuucuuc

SEQ ID NO: 81 - RNA, 19 nt, artificial
  Completely synthesized
agaugacaaugagguuucu

SEQ ID NO: 82 - RNA, 19 nt, artificial
  Completely synthesized
guagaugacaaugagguuu

SEQ ID NO: 83 - RNA, 19 nt, artificial
  Completely synthesized
ugccaacuacucccagguu

SEQ ID NO: 84 - RNA, 19 nt, artificial
  Completely synthesized
aagccagauguuaagaaaa

SEQ ID NO: 85 - RNA, 19 nt, artificial
  Completely synthesized
accuuauucuccuagugaa

SEQ ID NO: 86 - RNA, 19 nt, artificial
  Completely synthesized
accuacugaaaaaacaacu

SEQ ID NO: 87 - RNA, 19 nt, artificial
  Completely synthesized
acaaaagccuucaccuacu

SEQ ID NO: 88 - RNA, 19 nt, artificial
  Completely synthesized
ugcucaaagaaaaaggaga

SEQ ID NO: 89 - RNA, 19 nt, artificial
  Completely synthesized
caacuugcauuaauucggg

SEQ ID NO: 90 - RNA, 19 nt, artificial
  Completely synthesized
ggaaagacaagaacaacuc

SEQ ID NO: 91 - RNA, 19 nt, artificial
  Completely synthesized
uugaaaaggaaagacaaga

SEQ ID NO: 92 - RNA, 19 nt, artificial
  Completely synthesized
caaaagacaaacauucaag

SEQ ID NO: 93 - RNA, 19 nt, artificial
  Completely synthesized
ucacaaaagacaaacauuc

SEQ ID NO: 94 - RNA, 19 nt, artificial
  Completely synthesized
accccauucacaaaagaca

SEQ ID NO: 95 - RNA, 19 nt, artificial
  Completely synthesized
agaauugccuguaaguccu

SEQ ID NO: 96 - RNA, 19 nt, artificial
  Completely synthesized
agcgacggaaagaguauga

SEQ ID NO: 97 - RNA, 19 nt, artificial
  Completely synthesized
aagcacagcagaauucaau

SEQ ID NO: 98 - RNA, 19 nt, artificial
  Completely synthesized
cucugaacuucuaaauggg

SEQ ID NO: 99 - RNA, 19 nt, artificial
  Completely synthesized
uugacagugaacucauuaa

SEQ ID NO: 100 - RNA, 19 nt, artificial
  Completely synthesized
uaagucgagaaguauuuga

SEQ ID NO: 101 - RNA, 19 nt, artificial
  Completely synthesized
uggaguaagucgagaagua

SEQ ID NO: 102 - RNA, 19 nt, artificial
  Completely synthesized
uacucaucuauacccucaa

SEQ ID NO: 103 - RNA, 19 nt, artificial
  Completely synthesized
uccaaguccagaagccaaa

SEQ ID NO: 104 - RNA, 19 nt, artificial
  Completely synthesized
cuguugauuuagacgguau

SEQ ID NO: 105 - RNA, 19 nt, artificial
  Completely synthesized
uugcuacuaaucaggcuca

SEQ ID NO: 106 - RNA, 19 nt, artificial
  Completely synthesized
gcccagucuucauugcuac

SEQ ID NO: 107 - RNA, 19 nt, artificial
  Completely synthesized
cauucccguuuguagauga

SEQ ID NO: 108 - RNA, 19 nt, artificial
  Completely synthesized
augcuuuguacuuugauga

SEQ ID NO: 109 - RNA, 19 nt, artificial
  Completely synthesized
cagaugcuuuguacuuuga

SEQ ID NO: 110 - RNA, 19 nt, artificial
  Completely synthesized
aagagcugguacuaauaaa

SEQ ID NO: 111 - RNA, 19 nt, artificial
  Completely synthesized
ggacaaaaaauggcauuuu

SEQ ID NO: 112 - RNA, 19 nt, artificial
  Completely synthesized
gugaaaugcucauacuuua

SEQ ID NO: 113 - RNA, 19 nt, artificial
  Completely synthesized
aaccuuauucuccuaguga

SEQ ID NO: 114 - RNA, 19 nt, artificial
  Completely synthesized
aaaaccuuauucuccuagu

SEQ ID NO: 115 - RNA, 19 nt, artificial
  Completely synthesized
aaacaacucagcaccuuau

SEQ ID NO: 116 - RNA, 19 nt, artificial
  Completely synthesized
caccuacugaaaaaacaac

SEQ ID NO: 117 - RNA, 19 nt, artificial
  Completely synthesized
uucaccuacugaaaaaaca

SEQ ID NO: 118 - RNA, 19 nt, artificial
  Completely synthesized
acaagaacaacuccaaaag

SEQ ID NO: 119 - RNA, 19 nt, artificial
  Completely synthesized
uugcauuaauucgggauau

SEQ ID NO: 120 - RNA, 19 nt, artificial
  Completely synthesized
aacuugcauuaauucggga

SEQ ID NO: 121 - RNA, 19 nt, artificial
  Completely synthesized
cacaaaagacaaacauuca

SEQ ID NO: 122 - RNA, 19 nt, artificial
  Completely synthesized
cccauucacaaaagacaaa

SEQ ID NO: 123 - RNA, 19 nt, artificial
  Completely synthesized
gaacacaccagagaaagaa

SEQ ID NO: 124 - RNA, 19 nt, artificial
  Completely synthesized
acgguccacagcucaucau

SEQ ID NO: 125 - RNA, 19 nt, artificial
  Completely synthesized
ugagaacacaccagagaaa

SEQ ID NO: 126 - RNA, 19 nt, artificial
  Completely synthesized
gugauucugaaguggaaga

SEQ ID NO: 127 - RNA, 19 nt, artificial
  Completely synthesized
acagcagaauucaaugauu

SEQ ID NO: 128 - RNA, 19 nt, artificial
  Completely synthesized
gcacagcagaauucaauga

SEQ ID NO: 129 - RNA, 19 nt, artificial
  Completely synthesized
cucauuaaauucagaugcc

SEQ ID NO: 130 - RNA, 19 nt, artificial
  Completely synthesized
acucauuaaauucagaugc

SEQ ID NO: 131 - RNA, 19 nt, artificial
  Completely synthesized
aaccaguugacagugaacu

SEQ ID NO: 132 - RNA, 19 nt, artificial
  Completely synthesized
uccuucagcagcauccucu

SEQ ID NO: 133 - RNA, 19 nt, artificial
  Completely synthesized
gaggauuccuucagcagca

SEQ ID NO: 134 - RNA, 19 nt, artificial
  Completely synthesized
aguaagucgagaaguauuu

SEQ ID NO: 135 - RNA, 19 nt, artificial
  Completely synthesized
gaguaagucgagaaguauu

SEQ ID NO: 136 - RNA, 19 nt, artificial
  Completely synthesized
acucaucuauacccucaau

SEQ ID NO: 137 - RNA, 19 nt, artificial
  Completely synthesized
uuacucaucuauacccuca

SEQ ID NO: 138 - RNA, 19 nt, artificial
  Completely synthesized
ugaguuacagugucuuaau

SEQ ID NO: 139 - RNA, 19 nt, artificial
  Completely synthesized
uuuggaggcaagauauaga

SEQ ID NO: 140 - RNA, 19 nt, artificial
  Completely synthesized
aggacauugagcaaguuug

SEQ ID NO: 141 - RNA, 19 nt, artificial
  Completely synthesized
uagacgguaugcaacagga

SEQ ID NO: 142 - RNA, 19 nt, artificial
  Completely synthesized
uugauuuagacgguaugca

SEQ ID NO: 143 - RNA, 19 nt, artificial
  Completely synthesized
uucauugcuacuaaucagg

SEQ ID NO: 144 - RNA, 19 nt, artificial
  Completely synthesized
agucuucauugcuacuaau

SEQ ID NO: 145 - RNA, 19 nt, artificial
  Completely synthesized
cggcuacguuucagucacu

SEQ ID NO: 146 - RNA, 19 nt, artificial
  Completely synthesized
aggacauggauuugauuga

SEQ ID NO: 147 - RNA, 19 nt, artificial
  Completely synthesized
gcccacauucccaaaucag

SEQ ID NO: 148 - RNA, 19 nt, artificial
  Completely synthesized
agcaggacauggauuugau

SEQ ID NO: 149 - RNA, 19 nt, artificial
  Completely synthesized
agcugguacuaauaaagga

SEQ ID NO: 150 - RNA, 19 nt, artificial
  Completely synthesized
gagcugguacuaauaaagg

SEQ ID NO: 151 - RNA, 19 nt, artificial
  Completely synthesized
agagcugguacuaauaaag

SEQ ID NO: 152 - RNA, 19 nt, artificial
  Completely synthesized
cuaaccacuauguacuuuu

SEQ ID NO: 153 - RNA, 19 nt, artificial
  Completely synthesized
acaucuggcuaaaaagaaa

SEQ ID NO: 154 - RNA, 19 nt, artificial
  Completely synthesized
cuguucuuaugucauuugu

SEQ ID NO: 155 - RNA, 19 nt, artificial
  Completely synthesized
ugggcuaguuucuguguaa

SEQ ID NO: 156 - RNA, 19 nt, artificial
  Completely synthesized
guaaacaauuucuuaggac

SEQ ID NO: 157 - RNA, 19 nt, artificial
  Completely synthesized
cuguaaacaauuucuuagg

SEQ ID NO: 158 - RNA, 19 nt, artificial
  Completely synthesized
gucaguauguugaaucagu

SEQ ID NO: 159 - RNA, 19 nt, artificial
  Completely synthesized
ggcaauguuuuccuuguuc

SEQ ID NO: 160 - RNA, 19 nt, artificial
  Completely synthesized
gcaccuuauaucucgaagu

SEQ ID NO: 161 - RNA, 19 nt, artificial
  Completely synthesized
gaaaaaacaacucagcacc

SEQ ID NO: 162 - RNA, 19 nt, artificial
  Completely synthesized
agagcaagauuuagaucau

SEQ ID NO: 163 - RNA, 19 nt, artificial
  Completely synthesized
uagagcaagauuuagauca

SEQ ID NO: 164 - RNA, 19 nt, artificial
  Completely synthesized
uagaacuagagcaagauuu

SEQ ID NO: 165 - RNA, 19 nt, artificial
  Completely synthesized
acguaggagggguaagaau

SEQ ID NO: 166 - RNA, 19 nt, artificial
  Completely synthesized
ucccuguuguugacuucaa

SEQ ID NO: 167 - RNA, 19 nt, artificial
  Completely synthesized
ucccuguagaaaaaaucau

SEQ ID NO: 168 - RNA, 19 nt, artificial
  Completely synthesized
ucacaagagaugaacuuag

SEQ ID NO: 169 - RNA, 19 nt, artificial
  Completely synthesized
agagaaagaauugccugua

SEQ ID NO: 170 - RNA, 19 nt, artificial
  Completely synthesized
accagagaaagaauugccu

SEQ ID NO: 171 - RNA, 19 nt, artificial
  Completely synthesized
caccagagaaagaauugcc

SEQ ID NO: 172 - RNA, 19 nt, artificial
  Completely synthesized
aguaugagcuggaaaaaca

SEQ ID NO: 173 - RNA, 19 nt, artificial
  Completely synthesized
guacauucuucuggggaua

SEQ ID NO: 174 - RNA, 19 nt, artificial
  Completely synthesized
caaacagaaugguccuaaa

SEQ ID NO: 175 - RNA, 19 nt, artificial
  Completely synthesized
cuggaagugucaaacagaa

SEQ ID NO: 176 - RNA, 19 nt, artificial
  Completely synthesized
ggaaagaguaugagcugga

SEQ ID NO: 177 - RNA, 19 nt, artificial
  Completely synthesized
cagugauucugaaguggaa

SEQ ID NO: 178 - RNA, 19 nt, artificial
  Completely synthesized
gacggaaagaguaugagcu

SEQ ID NO: 179 - RNA, 19 nt, artificial
  Completely synthesized
cacagcagaauucaaugau

SEQ ID NO: 180 - RNA, 19 nt, artificial
  Completely synthesized
gccacagucaacacagauu

SEQ ID NO: 181 - RNA, 19 nt, artificial
  Completely synthesized
uaaauucagaugccacagu

SEQ ID NO: 182 - RNA, 19 nt, artificial
  Completely synthesized
ccaguugacagugaacuca

SEQ ID NO: 183 - RNA, 19 nt, artificial
  Completely synthesized
gucgagaaguauuugacuu

SEQ ID NO: 184 - RNA, 19 nt, artificial
  Completely synthesized
cuguaguccacauuuucuu

SEQ ID NO: 185 - RNA, 19 nt, artificial
  Completely synthesized
ggaguaagucgagaaguau

SEQ ID NO: 186 - RNA, 19 nt, artificial
  Completely synthesized
gacagaaguugacaauuau

SEQ ID NO: 187 - RNA, 19 nt, artificial
  Completely synthesized
gagacuaccaugguuccaa

SEQ ID NO: 188 - RNA, 19 nt, artificial
  Completely synthesized
cuauuauccauuccugagu

SEQ ID NO: 189 - RNA, 19 nt, artificial
  Completely synthesized
gacgguaugcaacaggaca

SEQ ID NO: 190 - RNA, 19 nt, artificial
  Completely synthesized
cgagagcccagucuucauu

SEQ ID NO: 191 - RNA, 19 nt, artificial
  Completely synthesized
uugauugacauacuuugga

SEQ ID NO: 192 - RNA, 19 nt, artificial
  Completely synthesized
gucacuuguuccugauauu

SEQ ID NO: 193 - RNA, 19 nt, artificial
  Completely synthesized
ucggcuacguuucagucac

SEQ ID NO: 194 - RNA, 19 nt, artificial
  Completely synthesized
gagguuucuucggcuacgu

SEQ ID NO: 195 - RNA, 19 nt, artificial
  Completely synthesized
gacauucccguuuguagau

SEQ ID NO: 196 - RNA, 19 nt, artificial
  Completely synthesized
gacauggauuugauugaca

SEQ ID NO: 197 - RNA, 19 nt, artificial
  Completely synthesized
ucagaugcuuuguacuuug

SEQ ID NO: 198 - RNA, 19 nt, artificial
  Completely synthesized
cagcaggacauggauuuga

SEQ ID NO: 199 - RNA, 19 nt, artificial
  Completely synthesized
auggacaaaaaauggcauu

SEQ ID NO: 200 - RNA, 19 nt, artificial
  Completely synthesized
guauggacaaaaaauggca

SEQ ID NO: 201 - RNA, 19 nt, artificial
  Completely synthesized
caucuggcuaaaaagaaau

SEQ ID NO: 202 - RNA, 19 nt, artificial
  Completely synthesized
gacaucuggcuaaaaagaa

SEQ ID NO: 203 - RNA, 19 nt, artificial
  Completely synthesized
gagcuaguuuuuuuguacu

SEQ ID NO: 204 - RNA, 19 nt, artificial
  Completely synthesized
gaagauggaaaaccuuauu

SEQ ID NO: 205 - RNA, 19 nt, artificial
  Completely synthesized
gcuacgugaugaagaugga

SEQ ID NO: 206 - RNA, 19 nt, artificial
  Completely synthesized
ugcuacgugaugaagaugg

SEQ ID NO: 207 - RNA, 19 nt, artificial
  Completely synthesized
gagcaagauuuagaucauu

SEQ ID NO: 208 - RNA, 19 nt, artificial
  Completely synthesized
acuagagcaagauuuagau

SEQ ID NO: 209 - RNA, 19 nt, artificial
  Completely synthesized
uaguagaacuagagcaaga

SEQ ID NO: 210 - RNA, 19 nt, artificial
  Completely synthesized
auaucccauucccuguaga

SEQ ID NO: 211 - RNA, 19 nt, artificial
  Completely synthesized
ccauaucccauucccugua

SEQ ID NO: 212 - RNA, 19 nt, artificial
  Completely synthesized
ccccauucacaaaagacaa

SEQ ID NO: 213 - RNA, 19 nt, artificial
  Completely synthesized
acaccagagaaagaauugc

SEQ ID NO: 214 - RNA, 19 nt, artificial
  Completely synthesized
ucaaacagaaugguccuaa

SEQ ID NO: 215 - RNA, 19 nt, artificial
  Completely synthesized
aagaguaugagcuggaaaa

SEQ ID NO: 216 - RNA, 19 nt, artificial
  Completely synthesized
ugccccuggaagugucaaa

SEQ ID NO: 217 - RNA, 19 nt, artificial
  Completely synthesized
gcgacggaaagaguaugag

SEQ ID NO: 218 - RNA, 19 nt, artificial
  Completely synthesized
cugaacuucuaaaugggcc

SEQ ID NO: 219 - RNA, 19 nt, artificial
  Completely synthesized
ccacagucaacacagauuu

SEQ ID NO: 220 - RNA, 19 nt, artificial
  Completely synthesized
augcuuuugaggauuccuu

SEQ ID NO: 221 - RNA, 19 nt, artificial
  Completely synthesized
cucaauggaaaaagaagua

SEQ ID NO: 222 - RNA, 19 nt, artificial
  Completely synthesized
cucaucuauacccucaaug

SEQ ID NO: 223 - RNA, 19 nt, artificial
  Completely synthesized
acauugagcaaguuuggga

SEQ ID NO: 224 - RNA, 19 nt, artificial
  Completely synthesized
aacaggacauugagcaagu

SEQ ID NO: 225 - RNA, 19 nt, artificial
  Completely synthesized
uuagacgguaugcaacagg

SEQ ID NO: 226 - RNA, 19 nt, artificial
  Completely synthesized
accugaaacuucuguugcu

SEQ ID NO: 227 - RNA, 19 nt, artificial
  Completely synthesized
ccagucuucauugcuacua

SEQ ID NO: 228 - RNA, 19 nt, artificial
  Completely synthesized
agagcccagucuucauugc

SEQ ID NO: 229 - RNA, 19 nt, artificial
  Completely synthesized
agucacuuguuccugauau

SEQ ID NO: 230 - RNA, 19 nt, artificial
  Completely synthesized
uggauuugauugacauacu

SEQ ID NO: 231 - RNA, 19 nt, artificial
  Completely synthesized
caaugagguuucuucggcu

SEQ ID NO: 232 - RNA, 19 nt, artificial
  Completely synthesized
acaaugagguuucuucggc

SEQ ID NO: 233 - RNA, 19 nt, artificial
  Completely synthesized
agacauucccguuuguaga

SEQ ID NO: 234 - RNA, 19 nt, artificial
  Completely synthesized
gcuuuguacuuugaugacu

SEQ ID NO: 235 - RNA, 19 nt, artificial
  Completely synthesized
cccacauucccaaaucaga

SEQ ID NO: 236 - RNA, 19 nt, artificial
  Completely synthesized
acaacuagaugaagagaca

SEQ ID NO: 237 - RNA, 19 nt, artificial
  Completely synthesized
uacaacuagaugaagagac

SEQ ID NO: 238 - RNA, 19 nt, artificial
  Completely synthesized
uuuaagagcugguacuaau

SEQ ID NO: 239 - RNA, 19 nt, artificial
  Completely synthesized
uggacaaaaaauggcauuu

SEQ ID NO: 240 - RNA, 19 nt, artificial
  Completely synthesized
gggcuaguuucuguguaag

SEQ ID NO: 241 - RNA, 19 nt, artificial
  Completely synthesized
uugggcuaguuucugugua

SEQ ID NO: 242 - RNA, 19 nt, artificial
  Completely synthesized
gugucaguauguugaauca

SEQ ID NO: 243 - RNA, 19 nt, artificial
  Completely synthesized
gaugugaaaugcucauacu

SEQ ID NO: 244 - RNA, 19 nt, artificial
  Completely synthesized
cuccuacugugaugugaaa

SEQ ID NO: 245 - RNA, 19 nt, artificial
  Completely synthesized
agauuuaggaggauuugac

SEQ ID NO: 246 - RNA, 19 nt, artificial
  Completely synthesized
gcaauguuuuccuuguucc

SEQ ID NO: 247 - RNA, 19 nt, artificial
  Completely synthesized
aacaagagauggcaauguu

SEQ ID NO: 248 - RNA, 19 nt, artificial
  Completely synthesized
gcagcaaacaagagauggc

SEQ ID NO: 249 - RNA, 19 nt, artificial
  Completely synthesized
cuccuagugaauacucccu

SEQ ID NO: 250 - RNA, 19 nt, artificial
  Completely synthesized
cagcaccuuauaucucgaa

SEQ ID NO: 251 - RNA, 19 nt, artificial
  Completely synthesized
ucaccuacugaaaaaacaa

SEQ ID NO: 252 - RNA, 19 nt, artificial
  Completely synthesized
gcaagauuuagaucauuug

SEQ ID NO: 253 - RNA, 19 nt, artificial
  Completely synthesized
cagaaaaagaaaacuggaa

SEQ ID NO: 254 - RNA, 19 nt, artificial
  Completely synthesized
auacguaggagggguaaga

SEQ ID NO: 255 - RNA, 19 nt, artificial
  Completely synthesized
ugcauuaauucgggauaua

SEQ ID NO: 256 - RNA, 19 nt, artificial
  Completely synthesized
aagcucuccauaucccauu

SEQ ID NO: 257 - RNA, 19 nt, artificial
  Completely synthesized
cauucacaaaagacaaaca

SEQ ID NO: 258 - RNA, 19 nt, artificial
  Completely synthesized
gaguaugagcuggaaaaac

SEQ ID NO: 259 - RNA, 19 nt, artificial
  Completely synthesized
cagaaugguccuaaaacac

SEQ ID NO: 260 - RNA, 19 nt, artificial
  Completely synthesized
gugucaaacagaauggucc

SEQ ID NO: 261 - RNA, 19 nt, artificial
  Completely synthesized
gaagugucaaacagaaugg

SEQ ID NO: 262 - RNA, 19 nt, artificial
  Completely synthesized
cugaaguggaagagcuaga

SEQ ID NO: 263 - RNA, 19 nt, artificial
  Completely synthesized
ccagaacacucaguggaau

SEQ ID NO: 264 - RNA, 19 nt, artificial
  Completely synthesized
uucugacuccggcauuuca

SEQ ID NO: 265 - RNA, 19 nt, artificial
  Completely synthesized
augauucugacuccggcau

SEQ ID NO: 266 - RNA, 19 nt, artificial
  Completely synthesized
ggcccauugauguuucuga

SEQ ID NO: 267 - RNA, 19 nt, artificial
  Completely synthesized
cacagauuuuggugaugaa

SEQ ID NO: 268 - RNA, 19 nt, artificial
  Completely synthesized
caguugacagugaacucau

SEQ ID NO: 269 - RNA, 19 nt, artificial
  Completely synthesized
uuaaugcuuuugaggauuc

SEQ ID NO: 270 - RNA, 19 nt, artificial
  Completely synthesized
ucuuaaugcuuuugaggau

SEQ ID NO: 271 - RNA, 19 nt, artificial
  Completely synthesized
aguccacauuuucuuaaug

SEQ ID NO: 272 - RNA, 19 nt, artificial
  Completely synthesized
ugacagaaguugacaauua

SEQ ID NO: 273 - RNA, 19 nt, artificial
  Completely synthesized
ccaaacugacagaaguuga

SEQ ID NO: 274 - RNA, 19 nt, artificial
  Completely synthesized
guugagacuaccaugguuc

SEQ ID NO: 275 - RNA, 19 nt, artificial
  Completely synthesized
acaagcugguugagacuac

SEQ ID NO: 276 - RNA, 19 nt, artificial
  Completely synthesized
auacuuuggaggcaagaua

SEQ ID NO: 277 - RNA, 19 nt, artificial
  Completely synthesized
gacauacuuuggaggcaag

SEQ ID NO: 278 - RNA, 19 nt, artificial
  Completely synthesized
gucaccugaaacuucuguu

SEQ ID NO: 279 - RNA, 19 nt, artificial
  Completely synthesized
ucgagagcccagucuucau

SEQ ID NO: 280 - RNA, 19 nt, artificial
  Completely synthesized
guacuuugaugacugcaug

SEQ ID NO: 281 - RNA, 19 nt, artificial
  Completely synthesized
uguacuuugaugacugcau

SEQ ID NO: 282 - RNA, 19 nt, artificial
  Completely synthesized
ggacauggauuugauugac

SEQ ID NO: 283 - RNA, 19 nt, artificial
  Completely synthesized
gaugcuuuguacuuugaug

SEQ ID NO: 284 - RNA, 19 nt, artificial
  Completely synthesized
aucagaugcuuuguacuuu

SEQ ID NO: 285 - RNA, 19 nt, artificial
  Completely synthesized
uucccaaaucagaugcuuu

SEQ ID NO: 286 - RNA, 19 nt, artificial
  Completely synthesized
cauucccaaaucagaugcu

SEQ ID NO: 287 - RNA, 19 nt, artificial
  Completely synthesized
ccacauucccaaaucagau

SEQ ID NO: 288 - RNA, 19 nt, artificial
  Completely synthesized
aguuacaacuagaugaaga

SEQ ID NO: 289 - RNA, 19 nt, artificial
  Completely synthesized
uauggacaaaaaauggcau

SEQ ID NO: 290 - RNA, 19 nt, artificial
  Completely synthesized
acuguauggacaaaaaaug

SEQ ID NO: 291 - RNA, 19 nt, artificial
  Completely synthesized
uaugacaucuggcuaaaaa

SEQ ID NO: 292 - RNA, 19 nt, artificial
  Completely synthesized
acuguucuuaugucauuug

SEQ ID NO: 293 - RNA, 19 nt, artificial
  Completely synthesized
uaguuucuguguaagugua

SEQ ID NO: 294 - RNA, 19 nt, artificial
  Completely synthesized
ggcuaguuucuguguaagu

SEQ ID NO: 295 - RNA, 19 nt, artificial
  Completely synthesized
caauuucuuaggacaccau

SEQ ID NO: 296 - RNA, 19 nt, artificial
  Completely synthesized
guauguugaaucaguaguu

SEQ ID NO: 297 - RNA, 19 nt, artificial
  Completely synthesized
ucaguauguugaaucagua

SEQ ID NO: 298 - RNA, 19 nt, artificial
  Completely synthesized
ugaugugaaaugcucauac

SEQ ID NO: 299 - RNA, 19 nt, artificial
  Completely synthesized
aaagcuccuacugugaugu

SEQ ID NO: 300 - RNA, 19 nt, artificial
  Completely synthesized
uacuaaaagcuccuacugu

SEQ ID NO: 301 - RNA, 19 nt, artificial
  Completely synthesized
ggauuugaccuuuucugag

SEQ ID NO: 302 - RNA, 19 nt, artificial
  Completely synthesized
agagauggcaauguuuucc

SEQ ID NO: 303 - RNA, 19 nt, artificial
  Completely synthesized
aaacaagagauggcaaugu

SEQ ID NO: 304 - RNA, 19 nt, artificial
  Completely synthesized
cagcaaacaagagauggca

SEQ ID NO: 305 - RNA, 19 nt, artificial
  Completely synthesized
cuagugaauacucccugca

SEQ ID NO: 306 - RNA, 19 nt, artificial
  Completely synthesized
aagauggaaaaccuuauuc

SEQ ID NO: 307 - RNA, 19 nt, artificial
  Completely synthesized
cagcaugcuacgugaugaa

SEQ ID NO: 308 - RNA, 19 nt, artificial
  Completely synthesized
caccuuauaucucgaaguu

SEQ ID NO: 309 - RNA, 19 nt, artificial
  Completely synthesized
ucagcaccuuauaucucga

SEQ ID NO: 310 - RNA, 19 nt, artificial
  Completely synthesized
auauaguagaacuagagca

SEQ ID NO: 311 - RNA, 19 nt, artificial
  Completely synthesized
uugcagaaaaagaaaacug

SEQ ID NO: 312 - RNA, 19 nt, artificial
  Completely synthesized
acgaaaugauguccaaaga

SEQ ID NO: 313 - RNA, 19 nt, artificial
  Completely synthesized
accucccuguuguugacuu

SEQ ID NO: 314 - RNA, 19 nt, artificial
  Completely synthesized
cccuguagaaaaaaucauu

SEQ ID NO: 315 - RNA, 19 nt, artificial
  Completely synthesized
gagaugaacuuagggcaaa

SEQ ID NO: 316 - RNA, 19 nt, artificial
  Completely synthesized
cacaagagaugaacuuagg

SEQ ID NO: 317 - RNA, 19 nt, artificial
  Completely synthesized
aaccccauucacaaaagac

SEQ ID NO: 318 - RNA, 19 nt, artificial
  Completely synthesized
agaacacaccagagaaaga

SEQ ID NO: 319 - RNA, 19 nt, artificial
  Completely synthesized
gucaaacagaaugguccua

SEQ ID NO: 320 - RNA, 19 nt, artificial
  Completely synthesized
ggaagugucaaacagaaug

SEQ ID NO: 321 - RNA, 19 nt, artificial
  Completely synthesized
uggaagugucaaacagaau

SEQ ID NO: 322 - RNA, 19 nt, artificial
  Completely synthesized
cccuggaagugucaaacag

SEQ ID NO: 323 - RNA, 19 nt, artificial
  Completely synthesized
guggaagagcuagauagug

SEQ ID NO: 324 - RNA, 19 nt, artificial
  Completely synthesized
accagaacacucaguggaa

SEQ ID NO: 325 - RNA, 19 nt, artificial
  Completely synthesized
cagcgacggaaagaguaug

SEQ ID NO: 326 - RNA, 19 nt, artificial
  Completely synthesized
ugaucuaucacuuugcaaa

SEQ ID NO: 327 - RNA, 19 nt, artificial
  Completely synthesized
gcccauugauguuucugau

SEQ ID NO: 328 - RNA, 19 nt, artificial
  Completely synthesized
agucaacacagauuuuggu

SEQ ID NO: 329 - RNA, 19 nt, artificial
  Completely synthesized
aguugacagugaacucauu

SEQ ID NO: 330 - RNA, 19 nt, artificial
  Completely synthesized
acuguaguccacauuuucu

SEQ ID NO: 331 - RNA, 19 nt, artificial
  Completely synthesized
caauggaaaaagaaguagg

SEQ ID NO: 332 - RNA, 19 nt, artificial
  Completely synthesized
caaacugacagaaguugac

SEQ ID NO: 333 - RNA, 19 nt, artificial
  Completely synthesized
agacuaccaugguuccaag

SEQ ID NO: 334 - RNA, 19 nt, artificial
  Completely synthesized
acaggacauugagcaaguu

SEQ ID NO: 335 - RNA, 19 nt, artificial
  Completely synthesized
ugacauacuuuggaggcaa

SEQ ID NO: 336 - RNA, 19 nt, artificial
  Completely synthesized
acguuucagucacuuguuc

SEQ ID NO: 337 - RNA, 19 nt, artificial
  Completely synthesized
cuacguuucagucacuugu

SEQ ID NO: 338 - RNA, 19 nt, artificial
  Completely synthesized
ggcuacguuucagucacuu

SEQ ID NO: 339 - RNA, 19 nt, artificial
  Completely synthesized
ggauuugauugacauacuu

SEQ ID NO: 340 - RNA, 19 nt, artificial
  Completely synthesized
ucuucggcuacguuucagu

SEQ ID NO: 341 - RNA, 19 nt, artificial
  Completely synthesized
cagucagaaaccaguggau

SEQ ID NO: 342 - RNA, 19 nt, artificial
  Completely synthesized
ugaagagacaggugaauuu

SEQ ID NO: 343 - RNA, 19 nt, artificial
  Completely synthesized
uagaugaagagacagguga

SEQ ID NO: 344 - RNA, 19 nt, artificial
  Completely synthesized
uaagagcugguacuaauaa

SEQ ID NO: 345 - RNA, 19 nt, artificial
  Completely synthesized
cuguauggacaaaaaaugg

SEQ ID NO: 346 - RNA, 19 nt, artificial
  Completely synthesized
uggagugucaguauguuga

SEQ ID NO: 347 - RNA, 19 nt, artificial
  Completely synthesized
ugugaaaugcucauacuuu

SEQ ID NO: 348 - RNA, 19 nt, artificial
  Completely synthesized
gugaugugaaaugcucaua

SEQ ID NO: 349 - RNA, 19 nt, artificial
  Completely synthesized
agcuccuacugugauguga

SEQ ID NO: 350 - RNA, 19 nt, artificial
  Completely synthesized
uccuagugaauacucccug

SEQ ID NO: 351 - RNA, 19 nt, artificial
  Completely synthesized
uucuccuagugaauacucc

SEQ ID NO: 352 - RNA, 19 nt, artificial
  Completely synthesized
caugcuacgugaugaagau

SEQ ID NO: 353 - RNA, 19 nt, artificial
  Completely synthesized
gcaugcuacgugaugaaga

SEQ ID NO: 354 - RNA, 19 nt, artificial
  Completely synthesized
agcaccuuauaucucgaag

SEQ ID NO: 355 - RNA, 19 nt, artificial
  Completely synthesized
agaaaaaggagaaaaugac

SEQ ID NO: 356 - RNA, 19 nt, artificial
  Completely synthesized
ugcagaaaaagaaaacugg

SEQ ID NO: 357 - RNA, 19 nt, artificial
  Completely synthesized
ucauuaaccucccuguugu

SEQ ID NO: 358 - RNA, 19 nt, artificial
  Completely synthesized
aagugucaaacagaauggu

SEQ ID NO: 359 - RNA, 19 nt, artificial
  Completely synthesized
gaaagaguaugagcuggaa

SEQ ID NO: 360 - RNA, 19 nt, artificial
  Completely synthesized
aaagcacagcagaauucaa

SEQ ID NO: 361 - RNA, 19 nt, artificial
  Completely synthesized
auguuucugaucuaucacu

SEQ ID NO: 362 - RNA, 19 nt, artificial
  Completely synthesized
ugggcccauugauguuucu

SEQ ID NO: 363 - RNA, 19 nt, artificial
  Completely synthesized
cagucaacacagauuuugg

SEQ ID NO: 364 - RNA, 19 nt, artificial
  Completely synthesized
acagucaacacagauuuug

SEQ ID NO: 365 - RNA, 19 nt, artificial
  Completely synthesized
cacagucaacacagauuuu

SEQ ID NO: 366 - RNA, 19 nt, artificial
  Completely synthesized
acagaagaccccaaccagu

SEQ ID NO: 367 - RNA, 19 nt, artificial
  Completely synthesized
aggauuccuucagcagcau

SEQ ID NO: 368 - RNA, 19 nt, artificial
  Completely synthesized
aauggaaaaagaaguaggu

SEQ ID NO: 369 - RNA, 19 nt, artificial
  Completely synthesized
augacaagcugguugagac

SEQ ID NO: 370 - RNA, 19 nt, artificial
  Completely synthesized
uugagcaaguuugggagga

SEQ ID NO: 371 - RNA, 19 nt, artificial
  Completely synthesized
cugaaacuucuguugcuca

SEQ ID NO: 372 - RNA, 19 nt, artificial
  Completely synthesized
ucaccugaaacuucuguug

SEQ ID NO: 373 - RNA, 19 nt, artificial
  Completely synthesized
uugacauacuuuggaggca

SEQ ID NO: 374 - RNA, 19 nt, artificial
  Completely synthesized
ugauugacauacuuuggag

SEQ ID NO: 375 - RNA, 19 nt, artificial
  Completely synthesized
agguuucuucggcuacguu

SEQ ID NO: 376 - RNA, 19 nt, artificial
  Completely synthesized
auggauuugauugacauac

SEQ ID NO: 377 - RNA, 19 nt, artificial
  Completely synthesized
acauggauuugauugacau

SEQ ID NO: 378 - RNA, 19 nt, artificial
  Completely synthesized
uucucccaauucagccagc

SEQ ID NO: 379 - RNA, 19 nt, artificial
  Completely synthesized
aagagacaggugaauuucu

SEQ ID NO: 380 - RNA, 19 nt, artificial
  Completely synthesized
gaugaagagacaggugaau

SEQ ID NO: 381 - RNA, 19 nt, artificial
  Completely synthesized
aacuagaugaagagacagg

SEQ ID NO: 382 - RNA, 19 nt, artificial
  Completely synthesized
uugcaaaacuaaccacuau

SEQ ID NO: 383 - RNA, 19 nt, artificial
  Completely synthesized
ugacaucuggcuaaaaaga

SEQ ID NO: 384 - RNA, 19 nt, artificial
  Completely synthesized
gagugucaguauguugaau

SEQ ID NO: 385 - RNA, 19 nt, artificial
  Completely synthesized
aagcauuggagugucagua

SEQ ID NO: 386 - RNA, 19 nt, artificial
  Completely synthesized
gcuccuacugugaugugaa

SEQ ID NO: 387 - RNA, 19 nt, artificial
  Completely synthesized
gaccuuuucugagcuaguu

SEQ ID NO: 388 - RNA, 19 nt, artificial
  Completely synthesized
ugaccuuuucugagcuagu

SEQ ID NO: 389 - RNA, 19 nt, artificial
  Completely synthesized
ucaugauggacuuggagcu

SEQ ID NO: 390 - RNA, 19 nt, artificial
  Completely synthesized
ccuuauaucucgaaguuuu

SEQ ID NO: 391 - RNA, 19 nt, artificial
  Completely synthesized
cucagcaccuuauaucucg

SEQ ID NO: 392 - RNA, 19 nt, artificial
  Completely synthesized
gacaagaacaacuccaaaa

SEQ ID NO: 393 - RNA, 19 nt, artificial
  Completely synthesized
ucgggauauacguaggagg

SEQ ID NO: 394 - RNA, 19 nt, artificial
  Completely synthesized
uaauucgggauauacguag

SEQ ID NO: 395 - RNA, 19 nt, artificial
  Completely synthesized
gaaaugauguccaaagagc

SEQ ID NO: 396 - RNA, 19 nt, artificial
  Completely synthesized
aacgaaaugauguccaaag

SEQ ID NO: 397 - RNA, 19 nt, artificial
  Completely synthesized
gaaaaaaucauuaaccucc

SEQ ID NO: 398 - RNA, 19 nt, artificial
  Completely synthesized
agcucuccauaucccauuc

SEQ ID NO: 399 - RNA, 19 nt, artificial
  Completely synthesized
gcaaaagcucuccauaucc

SEQ ID NO: 400 - RNA, 19 nt, artificial
  Completely synthesized
aagagaugaacuuagggca

SEQ ID NO: 401 - RNA, 19 nt, artificial
  Completely synthesized
cuggaaaaacagaaaaaac

SEQ ID NO: 402 - RNA, 19 nt, artificial
  Completely synthesized
gagcuggaaaaacagaaaa

SEQ ID NO: 403 - RNA, 19 nt, artificial
  Completely synthesized
ccccuggaagugucaaaca

SEQ ID NO: 404 - RNA, 19 nt, artificial
  Completely synthesized
auucugaaguggaagagcu

SEQ ID NO: 405 - RNA, 19 nt, artificial
  Completely synthesized
caucaccagaacacucagu

SEQ ID NO: 406 - RNA, 19 nt, artificial
  Completely synthesized
cugaucuaucacuuugcaa

SEQ ID NO: 407 - RNA, 19 nt, artificial
  Completely synthesized
ucugaucuaucacuuugca

SEQ ID NO: 408 - RNA, 19 nt, artificial
  Completely synthesized
uucugaucuaucacuuugc

SEQ ID NO: 409 - RNA, 19 nt, artificial
  Completely synthesized
gagcccaguaucagcaaca

SEQ ID NO: 410 - RNA, 19 nt, artificial
  Completely synthesized
gaaguagguaacuguaguc

SEQ ID NO: 411 - RNA, 19 nt, artificial
  Completely synthesized
agaaguagguaacuguagu

SEQ ID NO: 412 - RNA, 19 nt, artificial
  Completely synthesized
aaaagaaguagguaacugu

SEQ ID NO: 413 - RNA, 19 nt, artificial
  Completely synthesized
gcaacaggacauugagcaa

SEQ ID NO: 414 - RNA, 19 nt, artificial
  Completely synthesized
cacuuguuccugauauucc

SEQ ID NO: 415 - RNA, 19 nt, artificial
  Completely synthesized
gcaggacauggauuugauu

SEQ ID NO: 416 - RNA, 19 nt, artificial
  Completely synthesized
guuucuguguaaguguaaa

SEQ ID NO: 417 - RNA, 19 nt, artificial
  Completely synthesized
gcauuggagugucaguaug

SEQ ID NO: 418 - RNA, 19 nt, artificial
  Completely synthesized
ugugaugugaaaugcucau

SEQ ID NO: 419 - RNA, 19 nt, artificial
  Completely synthesized
acuagauuuaggaggauuu

SEQ ID NO: 420 - RNA, 19 nt, artificial
  Completely synthesized
cucgaaguuuucagcaugc

SEQ ID NO: 421 - RNA, 19 nt, artificial
  Completely synthesized
aucucgaaguuuucagcau

SEQ ID NO: 422 - RNA, 19 nt, artificial
  Completely synthesized
gcagaaaaagaaaacugga

SEQ ID NO: 423 - RNA, 19 nt, artificial
  Completely synthesized
ggauauacguaggaggggu

SEQ ID NO: 424 - RNA, 19 nt, artificial
  Completely synthesized
aagacaagaacaacuccaa

SEQ ID NO: 425 - RNA, 19 nt, artificial
  Completely synthesized
aaagagcaguucaaugaag

SEQ ID NO: 426 - RNA, 19 nt, artificial
  Completely synthesized
ucaacgaaaugauguccaa

SEQ ID NO: 427 - RNA, 19 nt, artificial
  Completely synthesized
uaaccucccuguuguugac

SEQ ID NO: 428 - RNA, 19 nt, artificial
  Completely synthesized
caaaagcucuccauauccc

SEQ ID NO: 429 - RNA, 19 nt, artificial
  Completely synthesized
agaugaacuuagggcaaaa

SEQ ID NO: 430 - RNA, 19 nt, artificial
  Completely synthesized
agagaugaacuuagggcaa

SEQ ID NO: 431 - RNA, 19 nt, artificial
  Completely synthesized
agcuggaaaaacagaaaaa

SEQ ID NO: 432 - RNA, 19 nt, artificial
  Completely synthesized
uccuaaaacaccaguacau

SEQ ID NO: 433 - RNA, 19 nt, artificial
  Completely synthesized
ugauguuucugaucuauca

SEQ ID NO: 434 - RNA, 19 nt, artificial
  Completely synthesized
ccauugauguuucugaucu

SEQ ID NO: 435 - RNA, 19 nt, artificial
  Completely synthesized
aguauguugaaucaguagu

SEQ ID NO: 436 - RNA, 19 nt, artificial
  Completely synthesized
uucugagcuaguuuuuuug

SEQ ID NO: 437 - RNA, 19 nt, artificial
  Completely synthesized
ucgaaguuuucagcaugcu

SEQ ID NO: 438 - RNA, 19 nt, artificial
  Completely synthesized
auucgggauauacguagga

SEQ ID NO: 439 - RNA, 19 nt, artificial
  Completely synthesized
uguccaaagagcaguucaa

SEQ ID NO: 440 - RNA, 19 nt, artificial
  Completely synthesized
uucuggggauaugguacaa

SEQ ID NO: 441 - RNA, 19 nt, artificial
  Completely synthesized
cuucuggggauaugguaca

SEQ ID NO: 442 - RNA, 19 nt, artificial
  Completely synthesized
uguuucugaucuaucacuu

SEQ ID NO: 443 - RNA, 19 nt, artificial
  Completely synthesized
accugcuacuuuaagccau

SEQ ID NO: 444 - RNA, 19 nt, artificial
  Completely synthesized
guuucagucacuuguuccu

SEQ ID NO: 445 - RNA, 19 nt, artificial
  Completely synthesized
cacauccagucagaaacca

SEQ ID NO: 446 - RNA, 19 nt, artificial
  Completely synthesized
cugguacuaauaaaggauu

SEQ ID NO: 447 - RNA, 19 nt, artificial
  Completely synthesized
agugucaguauguugaauc

SEQ ID NO: 448 - RNA, 19 nt, artificial
  Completely synthesized
aaacuagauuuaggaggau

SEQ ID NO: 449 - RNA, 19 nt, artificial
  Completely synthesized
aaaacuagauuuaggagga

SEQ ID NO: 450 - RNA, 19 nt, artificial
  Completely synthesized
agcucaacuugcauuaauu

SEQ ID NO: 451 - RNA, 19 nt, artificial
  Completely synthesized
aagagcaguucaaugaagc

SEQ ID NO: 452 - RNA, 19 nt, artificial
  Completely synthesized
ugauguccaaagagcaguu

SEQ ID NO: 453 - RNA, 19 nt, artificial
  Completely synthesized
gaaaaccccauucacaaaa

SEQ ID NO: 454 - RNA, 19 nt, artificial
  Completely synthesized
ugagcuggaaaaacagaaa

SEQ ID NO: 455 - RNA, 19 nt, artificial
  Completely synthesized
uugauguuucugaucuauc

SEQ ID NO: 456 - RNA, 19 nt, artificial
  Completely synthesized
uugcccacauucccaaauc

SEQ ID NO: 457 - RNA, 19 nt, artificial
  Completely synthesized
gcacauccagucagaaacc

SEQ ID NO: 458 - RNA, 19 nt, artificial
  Completely synthesized
gcugguacuaauaaaggau

SEQ ID NO: 459 - RNA, 19 nt, artificial
  Completely synthesized
ggagugucaguauguugaa

SEQ ID NO: 460 - RNA, 19 nt, artificial
  Completely synthesized
ccuuuucugagcuaguuuu

SEQ ID NO: 461 - RNA, 19 nt, artificial
  Completely synthesized
cucaaagaaaaaggagaaa

SEQ ID NO: 462 - RNA, 19 nt, artificial
  Completely synthesized
agacaagaacaacuccaaa

SEQ ID NO: 463 - RNA, 19 nt, artificial
  Completely synthesized
augauguccaaagagcagu

SEQ ID NO: 464 - RNA, 19 nt, artificial
  Completely synthesized
augagcuggaaaaacagaa

SEQ ID NO: 465 - RNA, 19 nt, artificial
  Completely synthesized
guccuaaaacaccaguaca

SEQ ID NO: 466 - RNA, 19 nt, artificial
  Completely synthesized
aucagcaacagcaugcccu

SEQ ID NO: 467 - RNA, 19 nt, artificial
  Completely synthesized
aagccaaacugacagaagu

SEQ ID NO: 468 - RNA, 19 nt, artificial
  Completely synthesized
cguuuguagaugacaauga

SEQ ID NO: 469 - RNA, 19 nt, artificial
  Completely synthesized
guugcccacauucccaaau

SEQ ID NO: 470 - RNA, 19 nt, artificial
  Completely synthesized
gcaaacaagagauggcaau

SEQ ID NO: 471 - RNA, 19 nt, artificial
  Completely synthesized
auugcucaaagaaaaagga

SEQ ID NO: 472 - RNA, 19 nt, artificial
  Completely synthesized
aaaccccauucacaaaaga

SEQ ID NO: 473 - RNA, 19 nt, artificial
  Completely synthesized
aaguggaagagcuagauag

SEQ ID NO: 474 - RNA, 19 nt, artificial
  Completely synthesized
ucacuaaacacaaguccca

SEQ ID NO: 475 - RNA, 19 nt, artificial
  Completely synthesized
cggcauuucacuaaacaca

SEQ ID NO: 476 - RNA, 19 nt, artificial
  Completely synthesized
uuuaagccauucacucucu

SEQ ID NO: 477 - RNA, 19 nt, artificial
  Completely synthesized
caccugcuacuuuaagcca

SEQ ID NO: 478 - RNA, 19 nt, artificial
  Completely synthesized
ggaggagcuauuauccauu

SEQ ID NO: 479 - RNA, 19 nt, artificial
  Completely synthesized
gggaggagcuauuauccau

SEQ ID NO: 480 - RNA, 19 nt, artificial
  Completely synthesized
ucgcucaguuacaacuaga

SEQ ID NO: 481 - RNA, 19 nt, artificial
  Completely synthesized
ugaagauggaaaaccuuau

SEQ ID NO: 482 - RNA, 19 nt, artificial
  Completely synthesized
aagcucaacuugcauuaau

SEQ ID NO: 483 - RNA, 19 nt, artificial
  Completely synthesized
aaaaccccauucacaaaag

SEQ ID NO: 484 - RNA, 19 nt, artificial
  Completely synthesized
gcuauggagacacacuacu

SEQ ID NO: 485 - RNA, 19 nt, artificial
  Completely synthesized
guauuugacuucagucagc

SEQ ID NO: 486 - RNA, 19 nt, artificial
  Completely synthesized
ccugcuacuuuaagccauu

SEQ ID NO: 487 - RNA, 19 nt, artificial
  Completely synthesized
ugagcccaguaucagcaac

SEQ ID NO: 488 - RNA, 19 nt, artificial
  Completely synthesized
gagaaguauuugacuucag

SEQ ID NO: 489 - RNA, 19 nt, artificial
  Completely synthesized
uggaaaaagaaguagguaa

SEQ ID NO: 490 - RNA, 19 nt, artificial
  Completely synthesized
gaagccaaacugacagaag

SEQ ID NO: 491 - RNA, 19 nt, artificial
  Completely synthesized
cagaagccaaacugacaga

SEQ ID NO: 492 - RNA, 19 nt, artificial
  Completely synthesized
gaaaaugacaagcugguug

SEQ ID NO: 493 - RNA, 19 nt, artificial
  Completely synthesized
aaaaagcauuggaguguca

SEQ ID NO: 494 - RNA, 19 nt, artificial
  Completely synthesized
uaggaggauuugaccuuuu

SEQ ID NO: 495 - RNA, 19 nt, artificial
  Completely synthesized
agauggaaaaccuuauucu

SEQ ID NO: 496 - RNA, 19 nt, artificial
  Completely synthesized
gaagcucaacuugcauuaa

SEQ ID NO: 497 - RNA, 19 nt, artificial
  Completely synthesized
gcucuccauaucccauucc

SEQ ID NO: 498 - RNA, 19 nt, artificial
  Completely synthesized
ggaaaaccccauucacaaa

SEQ ID NO: 499 - RNA, 19 nt, artificial
  Completely synthesized
agagcacucacgugcauga

SEQ ID NO: 500 - RNA, 19 nt, artificial
  Completely synthesized
acccuugucaccaucucag

SEQ ID NO: 501 - RNA, 19 nt, artificial
  Completely synthesized
cuacuuggccucagugauu

SEQ ID NO: 502 - RNA, 19 nt, artificial
  Completely synthesized
gugaacucauuaaauucag

SEQ ID NO: 503 - RNA, 19 nt, artificial
  Completely synthesized
ggaaaaagaaguagguaac

SEQ ID NO: 504 - RNA, 19 nt, artificial
  Completely synthesized
cccugucgaaaaaaucauu

SEQ ID NO: 505 - RNA, 19 nt, artificial
  Completely synthesized
ucccugucgaaaaaaucau

SEQ ID NO: 506 - RNA, 19 nt, artificial
  Completely synthesized
ccugucgaaaaaaucauua

SEQ ID NO: 507 - RNA, 19 nt, artificial
  Completely synthesized
gccacuuuauucuuacccc

SEQ ID NO: 508 - RNA, 19 nt, artificial
  Completely synthesized
acuuuauucuuaccccucc

SEQ ID NO: 509 - RNA, 19 nt, artificial
  Completely synthesized
acauagugguuaguuuugc

SEQ ID NO: 510 - RNA, 19 nt, artificial
  Completely synthesized
cuuuugucauuuucuccuu

SEQ ID NO: 511 - RNA, 19 nt, artificial
  Completely synthesized
uucuuuuucugcaauucug

SEQ ID NO: 512 - RNA, 19 nt, artificial
  Completely synthesized
agccacuuuauucuuaccc

SEQ ID NO: 513 - RNA, 19 nt, artificial
  Completely synthesized
uaaaguagcaggugagggc

SEQ ID NO: 514 - RNA, 19 nt, artificial
  Completely synthesized
ccacuuuauucuuaccccu

SEQ ID NO: 515 - RNA, 19 nt, artificial
  Completely synthesized
cuuuauucuuaccccuccu

SEQ ID NO: 516 - RNA, 19 nt, artificial
  Completely synthesized
uugucaucuacaaacggga

SEQ ID NO: 517 - RNA, 19 nt, artificial
  Completely synthesized
gcuuuugucauuuucuccu

SEQ ID NO: 518 - RNA, 19 nt, artificial
  Completely synthesized
uuuuucugcaauucugagc

SEQ ID NO: 519 - RNA, 19 nt, artificial
  Completely synthesized
uuacaggcaauucuuucuc

SEQ ID NO: 520 - RNA, 19 nt, artificial
  Completely synthesized
uguuuagugaaaugccgga

SEQ ID NO: 521 - RNA, 19 nt, artificial
  Completely synthesized
uauuaagacacuguaacuc

SEQ ID NO: 522 - RNA, 19 nt, artificial
  Completely synthesized
uuucuauacuaguuuuggc

SEQ ID NO: 523 - RNA, 19 nt, artificial
  Completely synthesized
uuuuucuuaacaucuggcu

SEQ ID NO: 524 - RNA, 19 nt, artificial
  Completely synthesized
uuucuuaacaucuggcuuc

SEQ ID NO: 525 - RNA, 19 nt, artificial
  Completely synthesized
uucuuaacaucuggcuucu

SEQ ID NO: 526 - RNA, 19 nt, artificial
  Completely synthesized
ucuuuuucugcaauucuga

SEQ ID NO: 527 - RNA, 19 nt, artificial
  Completely synthesized
uuuauucuuaccccuccua

SEQ ID NO: 528 - RNA, 19 nt, artificial
  Completely synthesized
uuuagaaguucagagagug

SEQ ID NO: 529 - RNA, 19 nt, artificial
  Completely synthesized
ucuaaaucaacaggggcua

SEQ ID NO: 530 - RNA, 19 nt, artificial
  Completely synthesized
ugggaguaguuggcagauc

SEQ ID NO: 531 - RNA, 19 nt, artificial
  Completely synthesized
guuuuggcuaugauuuugc

SEQ ID NO: 532 - RNA, 19 nt, artificial
  Completely synthesized
uuaacaucuggcuucuuac

SEQ ID NO: 533 - RNA, 19 nt, artificial
  Completely synthesized
auucugagcagccacuuua

SEQ ID NO: 534 - RNA, 19 nt, artificial
  Completely synthesized
ugagcagccacuuuauucu

SEQ ID NO: 535 - RNA, 19 nt, artificial
  Completely synthesized
aguuguucuugucuuuccu

SEQ ID NO: 536 - RNA, 19 nt, artificial
  Completely synthesized
uuguucuugucuuuccuuu

SEQ ID NO: 537 - RNA, 19 nt, artificial
  Completely synthesized
ugucuuuccuuuucaaguu

SEQ ID NO: 538 - RNA, 19 nt, artificial
  Completely synthesized
agcggcuugaauguuuguc

SEQ ID NO: 539 - RNA, 19 nt, artificial
  Completely synthesized
uuagugaaaugccggaguc

SEQ ID NO: 540 - RNA, 19 nt, artificial
  Completely synthesized
cuuucagggugguuuuggu

SEQ ID NO: 541 - RNA, 19 nt, artificial
  Completely synthesized
auuuagaaguucagagagu

SEQ ID NO: 542 - RNA, 19 nt, artificial
  Completely synthesized
auuuaaugaguucacuguc

SEQ ID NO: 543 - RNA, 19 nt, artificial
  Completely synthesized
aauagcuccucccaaacuu

SEQ ID NO: 544 - RNA, 19 nt, artificial
  Completely synthesized
accucauugucaucuacaa

SEQ ID NO: 545 - RNA, 19 nt, artificial
  Completely synthesized
aguacauagugguuaguuu

SEQ ID NO: 546 - RNA, 19 nt, artificial
  Completely synthesized
aguuuuggcuaugauuuug

SEQ ID NO: 547 - RNA, 19 nt, artificial
  Completely synthesized
cuuaacaucuggcuucuua

SEQ ID NO: 548 - RNA, 19 nt, artificial
  Completely synthesized
uuuuccaucuucaucacgu

SEQ ID NO: 549 - RNA, 19 nt, artificial
  Completely synthesized
guucuacuauauuuuccag

SEQ ID NO: 550 - RNA, 19 nt, artificial
  Completely synthesized
guucuugucuuuccuuuuc

SEQ ID NO: 551 - RNA, 19 nt, artificial
  Completely synthesized
uucuugucuuuccuuuuca

SEQ ID NO: 552 - RNA, 19 nt, artificial
  Completely synthesized
gccaaguagugugucucca

SEQ ID NO: 553 - RNA, 19 nt, artificial
  Completely synthesized
ucagggugguuuugguuga

SEQ ID NO: 554 - RNA, 19 nt, artificial
  Completely synthesized
uuaaaguagcaggugaggg

SEQ ID NO: 555 - RNA, 19 nt, artificial
  Completely synthesized
uuuaaugaguucacuguca

SEQ ID NO: 556 - RNA, 19 nt, artificial
  Completely synthesized
aucuauaucuugccuccaa

SEQ ID NO: 557 - RNA, 19 nt, artificial
  Completely synthesized
caggaauggauaauagcuc

SEQ ID NO: 558 - RNA, 19 nt, artificial
  Completely synthesized
gaaaccucauugucaucua

SEQ ID NO: 559 - RNA, 19 nt, artificial
  Completely synthesized
ugauuugggaaugugggca

SEQ ID NO: 560 - RNA, 19 nt, artificial
  Completely synthesized
uucuauacuaguuuuggcu

SEQ ID NO: 561 - RNA, 19 nt, artificial
  Completely synthesized
acaucuggcuucuuacuuu

SEQ ID NO: 562 - RNA, 19 nt, artificial
  Completely synthesized
ucuggcuucuuacuuuugg

SEQ ID NO: 563 - RNA, 19 nt, artificial
  Completely synthesized
cuggcuucuuacuuuuggg

SEQ ID NO: 564 - RNA, 19 nt, artificial
  Completely synthesized
uuuccaucuucaucacgua

SEQ ID NO: 565 - RNA, 19 nt, artificial
  Completely synthesized
uucuccuuuuucuuugagc

SEQ ID NO: 566 - RNA, 19 nt, artificial
  Completely synthesized
ucuaaaucuugcucuaguu

SEQ ID NO: 567 - RNA, 19 nt, artificial
  Completely synthesized
caauucugagcagccacuu

SEQ ID NO: 568 - RNA, 19 nt, artificial
  Completely synthesized
uuauucuuaccccuccuac

SEQ ID NO: 569 - RNA, 19 nt, artificial
  Completely synthesized
ccgaauuaaugcaaguuga

SEQ ID NO: 570 - RNA, 19 nt, artificial
  Completely synthesized
uggaguuguucuugucuuu

SEQ ID NO: 571 - RNA, 19 nt, artificial
  Completely synthesized
cuuacaggcaauucuuucu

SEQ ID NO: 572 - RNA, 19 nt, artificial
  Completely synthesized
aauucuuucucuggugugu

SEQ ID NO: 573 - RNA, 19 nt, artificial
  Completely synthesized
agaagaauguacugguguu

SEQ ID NO: 574 - RNA, 19 nt, artificial
  Completely synthesized
gaagaauguacugguguuu

SEQ ID NO: 575 - RNA, 19 nt, artificial
  Completely synthesized
uguuuuaggaccauucugu

SEQ ID NO: 576 - RNA, 19 nt, artificial
  Completely synthesized
ugugcuuucagggugguuu

SEQ ID NO: 577 - RNA, 19 nt, artificial
  Completely synthesized
uuucagggugguuuugguu

SEQ ID NO: 578 - RNA, 19 nt, artificial
  Completely synthesized
ccauuuagaaguucagaga

SEQ ID NO: 579 - RNA, 19 nt, artificial
  Completely synthesized
uagaaguucagagagugaa

SEQ ID NO: 580 - RNA, 19 nt, artificial
  Completely synthesized
uuaagaaaauguggacuac

SEQ ID NO: 581 - RNA, 19 nt, artificial
  Completely synthesized
accagcuugucauuuucaa

SEQ ID NO: 582 - RNA, 19 nt, artificial
  Completely synthesized
uuaguagcaaugaagacug

SEQ ID NO: 583 - RNA, 19 nt, artificial
  Completely synthesized
gaagaaaccucauugucau

SEQ ID NO: 584 - RNA, 19 nt, artificial
  Completely synthesized
agaaaccucauugucaucu

SEQ ID NO: 585 - RNA, 19 nt, artificial
  Completely synthesized
aaaccucauugucaucuac

SEQ ID NO: 586 - RNA, 19 nt, artificial
  Completely synthesized
aaccugggaguaguuggca

SEQ ID NO: 587 - RNA, 19 nt, artificial
  Completely synthesized
uuuucuuaacaucuggcuu

SEQ ID NO: 588 - RNA, 19 nt, artificial
  Completely synthesized
uucacuaggagaauaaggu

SEQ ID NO: 589 - RNA, 19 nt, artificial
  Completely synthesized
aguuguuuuuucaguaggu

SEQ ID NO: 590 - RNA, 19 nt, artificial
  Completely synthesized
aguaggugaaggcuuuugu

SEQ ID NO: 591 - RNA, 19 nt, artificial
  Completely synthesized
ucuccuuuuucuuugagca

SEQ ID NO: 592 - RNA, 19 nt, artificial
  Completely synthesized
cccgaauuaaugcaaguug

SEQ ID NO: 593 - RNA, 19 nt, artificial
  Completely synthesized
gaguuguucuugucuuucc

SEQ ID NO: 594 - RNA, 19 nt, artificial
  Completely synthesized
ucuugucuuuccuuuucaa

SEQ ID NO: 595 - RNA, 19 nt, artificial
  Completely synthesized
cuugaauguuugucuuuug

SEQ ID NO: 596 - RNA, 19 nt, artificial
  Completely synthesized
gaauguuugucuuuuguga

SEQ ID NO: 597 - RNA, 19 nt, artificial
  Completely synthesized
ugucuuuugugaauggggu

SEQ ID NO: 598 - RNA, 19 nt, artificial
  Completely synthesized
aggacuuacaggcaauucu

SEQ ID NO: 599 - RNA, 19 nt, artificial
  Completely synthesized
ucauacucuuuccgucgcu

SEQ ID NO: 600 - RNA, 19 nt, artificial
  Completely synthesized
auugaauucugcugugcuu

SEQ ID NO: 601 - RNA, 19 nt, artificial
  Completely synthesized
cccauuuagaaguucagag

SEQ ID NO: 602 - RNA, 19 nt, artificial
  Completely synthesized
uuaaugaguucacugucaa

SEQ ID NO: 603 - RNA, 19 nt, artificial
  Completely synthesized
ucaaauacuucucgacuua

SEQ ID NO: 604 - RNA, 19 nt, artificial
  Completely synthesized
uacuucucgacuuacucca

SEQ ID NO: 605 - RNA, 19 nt, artificial
  Completely synthesized
uugaggguauagaugagua

SEQ ID NO: 606 - RNA, 19 nt, artificial
  Completely synthesized
uuuggcuucuggacuugga

SEQ ID NO: 607 - RNA, 19 nt, artificial
  Completely synthesized
auaccgucuaaaucaacag

SEQ ID NO: 608 - RNA, 19 nt, artificial
  Completely synthesized
ugagccugauuaguagcaa

SEQ ID NO: 609 - RNA, 19 nt, artificial
  Completely synthesized
guagcaaugaagacugggc

SEQ ID NO: 610 - RNA, 19 nt, artificial
  Completely synthesized
ucaucuacaaacgggaaug

SEQ ID NO: 611 - RNA, 19 nt, artificial
  Completely synthesized
ucaucaaaguacaaagcau

SEQ ID NO: 612 - RNA, 19 nt, artificial
  Completely synthesized
ucaaaguacaaagcaucug

SEQ ID NO: 613 - RNA, 19 nt, artificial
  Completely synthesized
uuuauuaguaccagcucuu

SEQ ID NO: 614 - RNA, 19 nt, artificial
  Completely synthesized
aaaaugccauuuuuugucc

SEQ ID NO: 615 - RNA, 19 nt, artificial
  Completely synthesized
uaaaguaugagcauuucac

SEQ ID NO: 616 - RNA, 19 nt, artificial
  Completely synthesized
ucacuaggagaauaagguu

SEQ ID NO: 617 - RNA, 19 nt, artificial
  Completely synthesized
acuaggagaauaagguuuu

SEQ ID NO: 618 - RNA, 19 nt, artificial
  Completely synthesized
auaaggugcugaguuguuu

SEQ ID NO: 619 - RNA, 19 nt, artificial
  Completely synthesized
guuguuuuuucaguaggug

SEQ ID NO: 620 - RNA, 19 nt, artificial
  Completely synthesized
uguuuuuucaguaggugaa

SEQ ID NO: 621 - RNA, 19 nt, artificial
  Completely synthesized
cuuuuggaguuguucuugu

SEQ ID NO: 622 - RNA, 19 nt, artificial
  Completely synthesized
auaucccgaauuaaugcaa

SEQ ID NO: 623 - RNA, 19 nt, artificial
  Completely synthesized
ucccgaauuaaugcaaguu

SEQ ID NO: 624 - RNA, 19 nt, artificial
  Completely synthesized
ugaauguuugucuuuugug

SEQ ID NO: 625 - RNA, 19 nt, artificial
  Completely synthesized
uuugucuuuugugaauggg

SEQ ID NO: 626 - RNA, 19 nt, artificial
  Completely synthesized
uucuuucucugguguguuc

SEQ ID NO: 627 - RNA, 19 nt, artificial
  Completely synthesized
augaugagcuguggaccgu

SEQ ID NO: 628 - RNA, 19 nt, artificial
  Completely synthesized
uuucucugguguguucuca

SEQ ID NO: 629 - RNA, 19 nt, artificial
  Completely synthesized
ucuuccacuucagaaucac

SEQ ID NO: 630 - RNA, 19 nt, artificial
  Completely synthesized
aaucauugaauucugcugu

SEQ ID NO: 631 - RNA, 19 nt, artificial
  Completely synthesized
ucauugaauucugcugugc

SEQ ID NO: 632 - RNA, 19 nt, artificial
  Completely synthesized
ggcaucugaauuuaaugag

SEQ ID NO: 633 - RNA, 19 nt, artificial
  Completely synthesized
gcaucugaauuuaaugagu

SEQ ID NO: 634 - RNA, 19 nt, artificial
  Completely synthesized
aguucacugucaacugguu

SEQ ID NO: 635 - RNA, 19 nt, artificial
  Completely synthesized
agaggaugcugcugaagga

SEQ ID NO: 636 - RNA, 19 nt, artificial
  Completely synthesized
ugcugcugaaggaauccuc

SEQ ID NO: 637 - RNA, 19 nt, artificial
  Completely synthesized
aaauacuucucgacuuacu

SEQ ID NO: 638 - RNA, 19 nt, artificial
  Completely synthesized
aauacuucucgacuuacuc

SEQ ID NO: 639 - RNA, 19 nt, artificial
  Completely synthesized
auugaggguauagaugagu

SEQ ID NO: 640 - RNA, 19 nt, artificial
  Completely synthesized
ugaggguauagaugaguaa

SEQ ID NO: 641 - RNA, 19 nt, artificial
  Completely synthesized
auuaagacacuguaacuca

SEQ ID NO: 642 - RNA, 19 nt, artificial
  Completely synthesized
ucuauaucuugccuccaaa

SEQ ID NO: 643 - RNA, 19 nt, artificial
  Completely synthesized
caaacuugcucaauguccu

SEQ ID NO: 644 - RNA, 19 nt, artificial
  Completely synthesized
uccuguugcauaccgucua

SEQ ID NO: 645 - RNA, 19 nt, artificial
  Completely synthesized
ugcauaccgucuaaaucaa

SEQ ID NO: 646 - RNA, 19 nt, artificial
  Completely synthesized
ccugauuaguagcaaugaa

SEQ ID NO: 647 - RNA, 19 nt, artificial
  Completely synthesized
auuaguagcaaugaagacu

SEQ ID NO: 648 - RNA, 19 nt, artificial
  Completely synthesized
agugacugaaacguagccg

SEQ ID NO: 649 - RNA, 19 nt, artificial
  Completely synthesized
ucaaucaaauccauguccu

SEQ ID NO: 650 - RNA, 19 nt, artificial
  Completely synthesized
cugauuugggaaugugggc

SEQ ID NO: 651 - RNA, 19 nt, artificial
  Completely synthesized
aucaaauccauguccugcu

SEQ ID NO: 652 - RNA, 19 nt, artificial
  Completely synthesized
uccuuuauuaguaccagcu

SEQ ID NO: 653 - RNA, 19 nt, artificial
  Completely synthesized
ccuuuauuaguaccagcuc

SEQ ID NO: 654 - RNA, 19 nt, artificial
  Completely synthesized
cuuuauuaguaccagcucu

SEQ ID NO: 655 - RNA, 19 nt, artificial
  Completely synthesized
aaaaguacauagugguuag

SEQ ID NO: 656 - RNA, 19 nt, artificial
  Completely synthesized
uuucuuuuuagccagaugu

SEQ ID NO: 657 - RNA, 19 nt, artificial
  Completely synthesized
acaaaugacauaagaacag

SEQ ID NO: 658 - RNA, 19 nt, artificial
  Completely synthesized
uuacacagaaacuagccca

SEQ ID NO: 659 - RNA, 19 nt, artificial
  Completely synthesized
guccuaagaaauuguuuac

SEQ ID NO: 660 - RNA, 19 nt, artificial
  Completely synthesized
ccuaagaaauuguuuacag

SEQ ID NO: 661 - RNA, 19 nt, artificial
  Completely synthesized
acugauucaacauacugac

SEQ ID NO: 662 - RNA, 19 nt, artificial
  Completely synthesized
gaacaaggaaaacauugcc

SEQ ID NO: 663 - RNA, 19 nt, artificial
  Completely synthesized
acuucgagauauaaggugc

SEQ ID NO: 664 - RNA, 19 nt, artificial
  Completely synthesized
ggugcugaguuguuuuuuc

SEQ ID NO: 665 - RNA, 19 nt, artificial
  Completely synthesized
augaucuaaaucuugcucu

SEQ ID NO: 666 - RNA, 19 nt, artificial
  Completely synthesized
ugaucuaaaucuugcucua

SEQ ID NO: 667 - RNA, 19 nt, artificial
  Completely synthesized
aaaucuugcucuaguucua

SEQ ID NO: 668 - RNA, 19 nt, artificial
  Completely synthesized
auucuuaccccuccuacgu

SEQ ID NO: 669 - RNA, 19 nt, artificial
  Completely synthesized
uugaagucaacaacaggga

SEQ ID NO: 670 - RNA, 19 nt, artificial
  Completely synthesized
augauuuuuucuacaggga

SEQ ID NO: 671 - RNA, 19 nt, artificial
  Completely synthesized
cuaaguucaucucuuguga

SEQ ID NO: 672 - RNA, 19 nt, artificial
  Completely synthesized
uacaggcaauucuuucucu

SEQ ID NO: 673 - RNA, 19 nt, artificial
  Completely synthesized
aggcaauucuuucucuggu

SEQ ID NO: 674 - RNA, 19 nt, artificial
  Completely synthesized
ggcaauucuuucucuggug

SEQ ID NO: 675 - RNA, 19 nt, artificial
  Completely synthesized
uguuuuuccagcucauacu

SEQ ID NO: 676 - RNA, 19 nt, artificial
  Completely synthesized
uauccccagaagaauguac

SEQ ID NO: 677 - RNA, 19 nt, artificial
  Completely synthesized
uuuaggaccauucuguuug

SEQ ID NO: 678 - RNA, 19 nt, artificial
  Completely synthesized
uucuguuugacacuuccag

SEQ ID NO: 679 - RNA, 19 nt, artificial
  Completely synthesized
uccagcucauacucuuucc

SEQ ID NO: 680 - RNA, 19 nt, artificial
  Completely synthesized
uuccacuucagaaucacug

SEQ ID NO: 681 - RNA, 19 nt, artificial
  Completely synthesized
agcucauacucuuuccguc

SEQ ID NO: 682 - RNA, 19 nt, artificial
  Completely synthesized
aucauugaauucugcugug

SEQ ID NO: 683 - RNA, 19 nt, artificial
  Completely synthesized
aaucuguguugacuguggc

SEQ ID NO: 684 - RNA, 19 nt, artificial
  Completely synthesized
acuguggcaucugaauuua

SEQ ID NO: 685 - RNA, 19 nt, artificial
  Completely synthesized
ugaguucacugucaacugg

SEQ ID NO: 686 - RNA, 19 nt, artificial
  Completely synthesized
aagucaaauacuucucgac

SEQ ID NO: 687 - RNA, 19 nt, artificial
  Completely synthesized
aagaaaauguggacuacag

SEQ ID NO: 688 - RNA, 19 nt, artificial
  Completely synthesized
auacuucucgacuuacucc

SEQ ID NO: 689 - RNA, 19 nt, artificial
  Completely synthesized
auaauugucaacuucuguc

SEQ ID NO: 690 - RNA, 19 nt, artificial
  Completely synthesized
uuggaaccaugguagucuc

SEQ ID NO: 691 - RNA, 19 nt, artificial
  Completely synthesized
acucaggaauggauaauag

SEQ ID NO: 692 - RNA, 19 nt, artificial
  Completely synthesized
uguccuguugcauaccguc

SEQ ID NO: 693 - RNA, 19 nt, artificial
  Completely synthesized
aaugaagacugggcucucg

SEQ ID NO: 694 - RNA, 19 nt, artificial
  Completely synthesized
uccaaaguaugucaaucaa

SEQ ID NO: 695 - RNA, 19 nt, artificial
  Completely synthesized
aauaucaggaacaagugac

SEQ ID NO: 696 - RNA, 19 nt, artificial
  Completely synthesized
gugacugaaacguagccga

SEQ ID NO: 697 - RNA, 19 nt, artificial
  Completely synthesized
acguagccgaagaaaccuc

SEQ ID NO: 698 - RNA, 19 nt, artificial
  Completely synthesized
aucuacaaacgggaauguc

SEQ ID NO: 699 - RNA, 19 nt, artificial
  Completely synthesized
ugucaaucaaauccauguc

SEQ ID NO: 700 - RNA, 19 nt, artificial
  Completely synthesized
caaaguacaaagcaucuga

SEQ ID NO: 701 - RNA, 19 nt, artificial
  Completely synthesized
ucaaauccauguccugcug

SEQ ID NO: 702 - RNA, 19 nt, artificial
  Completely synthesized
aaugccauuuuuuguccau

SEQ ID NO: 703 - RNA, 19 nt, artificial
  Completely synthesized
ugccauuuuuuguccauac

SEQ ID NO: 704 - RNA, 19 nt, artificial
  Completely synthesized
auuucuuuuuagccagaug

SEQ ID NO: 705 - RNA, 19 nt, artificial
  Completely synthesized
uucuuuuuagccagauguc

SEQ ID NO: 706 - RNA, 19 nt, artificial
  Completely synthesized
aguacaaaaaaacuagcuc

SEQ ID NO: 707 - RNA, 19 nt, artificial
  Completely synthesized
aauaagguuuuccaucuuc

SEQ ID NO: 708 - RNA, 19 nt, artificial
  Completely synthesized
uccaucuucaucacguagc

SEQ ID NO: 709 - RNA, 19 nt, artificial
  Completely synthesized
ccaucuucaucacguagca

SEQ ID NO: 710 - RNA, 19 nt, artificial
  Completely synthesized
aaugaucuaaaucuugcuc

SEQ ID NO: 711 - RNA, 19 nt, artificial
  Completely synthesized
aucuaaaucuugcucuagu

SEQ ID NO: 712 - RNA, 19 nt, artificial
  Completely synthesized
ucuugcucuaguucuacua

SEQ ID NO: 713 - RNA, 19 nt, artificial
  Completely synthesized
ucuacagggaaugggauau

SEQ ID NO: 714 - RNA, 19 nt, artificial
  Completely synthesized
uacagggaaugggauaugg

SEQ ID NO: 715 - RNA, 19 nt, artificial
  Completely synthesized
uugucuuuugugaaugggg

SEQ ID NO: 716 - RNA, 19 nt, artificial
  Completely synthesized
gcaauucuuucucuggugu

SEQ ID NO: 717 - RNA, 19 nt, artificial
  Completely synthesized
uuaggaccauucuguuuga

SEQ ID NO: 718 - RNA, 19 nt, artificial
  Completely synthesized
uuuuccagcucauacucuu

SEQ ID NO: 719 - RNA, 19 nt, artificial
  Completely synthesized
uuugacacuuccaggggca

SEQ ID NO: 720 - RNA, 19 nt, artificial
  Completely synthesized
cucauacucuuuccgucgc

SEQ ID NO: 721 - RNA, 19 nt, artificial
  Completely synthesized
ggcccauuuagaaguucag

SEQ ID NO: 722 - RNA, 19 nt, artificial
  Completely synthesized
aaaucuguguugacugugg

SEQ ID NO: 723 - RNA, 19 nt, artificial
  Completely synthesized
aaggaauccucaaaagcau

SEQ ID NO: 724 - RNA, 19 nt, artificial
  Completely synthesized
uacuucuuuuuccauugag

SEQ ID NO: 725 - RNA, 19 nt, artificial
  Completely synthesized
cauugaggguauagaugag

SEQ ID NO: 726 - RNA, 19 nt, artificial
  Completely synthesized
ucccaaacuugcucaaugu

SEQ ID NO: 727 - RNA, 19 nt, artificial
  Completely synthesized
acuugcucaauguccuguu

SEQ ID NO: 728 - RNA, 19 nt, artificial
  Completely synthesized
ccuguugcauaccgucuaa

SEQ ID NO: 729 - RNA, 19 nt, artificial
  Completely synthesized
agcaacagaaguuucaggu

SEQ ID NO: 730 - RNA, 19 nt, artificial
  Completely synthesized
uaguagcaaugaagacugg

SEQ ID NO: 731 - RNA, 19 nt, artificial
  Completely synthesized
gcaaugaagacugggcucu

SEQ ID NO: 732 - RNA, 19 nt, artificial
  Completely synthesized
auaucaggaacaagugacu

SEQ ID NO: 733 - RNA, 19 nt, artificial
  Completely synthesized
aguaugucaaucaaaucca

SEQ ID NO: 734 - RNA, 19 nt, artificial
  Completely synthesized
agccgaagaaaccucauug

SEQ ID NO: 735 - RNA, 19 nt, artificial
  Completely synthesized
gccgaagaaaccucauugu

SEQ ID NO: 736 - RNA, 19 nt, artificial
  Completely synthesized
ucuacaaacgggaaugucu

SEQ ID NO: 737 - RNA, 19 nt, artificial
  Completely synthesized
agucaucaaaguacaaagc

SEQ ID NO: 738 - RNA, 19 nt, artificial
  Completely synthesized
ucugauuugggaauguggg

SEQ ID NO: 739 - RNA, 19 nt, artificial
  Completely synthesized
ugucucuucaucuaguugu

SEQ ID NO: 740 - RNA, 19 nt, artificial
  Completely synthesized
gucucuucaucuaguugua

SEQ ID NO: 741 - RNA, 19 nt, artificial
  Completely synthesized
auuaguaccagcucuuaaa

SEQ ID NO: 742 - RNA, 19 nt, artificial
  Completely synthesized
aaaugccauuuuuugucca

SEQ ID NO: 743 - RNA, 19 nt, artificial
  Completely synthesized
cuuacacagaaacuagccc

SEQ ID NO: 744 - RNA, 19 nt, artificial
  Completely synthesized
uacacagaaacuagcccaa

SEQ ID NO: 745 - RNA, 19 nt, artificial
  Completely synthesized
ugauucaacauacugacac

SEQ ID NO: 746 - RNA, 19 nt, artificial
  Completely synthesized
aguaugagcauuucacauc

SEQ ID NO: 747 - RNA, 19 nt, artificial
  Completely synthesized
uuucacaucacaguaggag

SEQ ID NO: 748 - RNA, 19 nt, artificial
  Completely synthesized
gucaaauccuccuaaaucu

SEQ ID NO: 749 - RNA, 19 nt, artificial
  Completely synthesized
ggaacaaggaaaacauugc

SEQ ID NO: 750 - RNA, 19 nt, artificial
  Completely synthesized
aacauugccaucucuuguu

SEQ ID NO: 751 - RNA, 19 nt, artificial
  Completely synthesized
gccaucucuuguuugcugc

SEQ ID NO: 752 - RNA, 19 nt, artificial
  Completely synthesized
agggaguauucacuaggag

SEQ ID NO: 753 - RNA, 19 nt, artificial
  Completely synthesized
uucgagauauaaggugcug

SEQ ID NO: 754 - RNA, 19 nt, artificial
  Completely synthesized
uuguuuuuucaguagguga

SEQ ID NO: 755 - RNA, 19 nt, artificial
  Completely synthesized
caaaugaucuaaaucuugc

SEQ ID NO: 756 - RNA, 19 nt, artificial
  Completely synthesized
uuccaguuuucuuuuucug

SEQ ID NO: 757 - RNA, 19 nt, artificial
  Completely synthesized
ucuuaccccuccuacguau

SEQ ID NO: 758 - RNA, 19 nt, artificial
  Completely synthesized
uauaucccgaauuaaugca

SEQ ID NO: 759 - RNA, 19 nt, artificial
  Completely synthesized
aaugggauauggagagcuu

SEQ ID NO: 760 - RNA, 19 nt, artificial
  Completely synthesized
uguuugucuuuugugaaug

SEQ ID NO: 761 - RNA, 19 nt, artificial
  Completely synthesized
guuuuuccagcucauacuc

SEQ ID NO: 762 - RNA, 19 nt, artificial
  Completely synthesized
guguuuuaggaccauucug

SEQ ID NO: 763 - RNA, 19 nt, artificial
  Completely synthesized
ggaccauucuguuugacac

SEQ ID NO: 764 - RNA, 19 nt, artificial
  Completely synthesized
ccauucuguuugacacuuc

SEQ ID NO: 765 - RNA, 19 nt, artificial
  Completely synthesized
ucuagcucuuccacuucag

SEQ ID NO: 766 - RNA, 19 nt, artificial
  Completely synthesized
auuccacugaguguucugg

SEQ ID NO: 767 - RNA, 19 nt, artificial
  Completely synthesized
ugaaaugccggagucagaa

SEQ ID NO: 768 - RNA, 19 nt, artificial
  Completely synthesized
augccggagucagaaucau

SEQ ID NO: 769 - RNA, 19 nt, artificial
  Completely synthesized
ucagaaacaucaaugggcc

SEQ ID NO: 770 - RNA, 19 nt, artificial
  Completely synthesized
uucaucaccaaaaucugug

SEQ ID NO: 771 - RNA, 19 nt, artificial
  Completely synthesized
augaguucacugucaacug

SEQ ID NO: 772 - RNA, 19 nt, artificial
  Completely synthesized
gaauccucaaaagcauuaa

SEQ ID NO: 773 - RNA, 19 nt, artificial
  Completely synthesized
auccucaaaagcauuaaga

SEQ ID NO: 774 - RNA, 19 nt, artificial
  Completely synthesized
cauuaagaaaauguggacu

SEQ ID NO: 775 - RNA, 19 nt, artificial
  Completely synthesized
uaauugucaacuucuguca

SEQ ID NO: 776 - RNA, 19 nt, artificial
  Completely synthesized
ucaacuucugucaguuugg

SEQ ID NO: 777 - RNA, 19 nt, artificial
  Completely synthesized
gaaccaugguagucucaac

SEQ ID NO: 778 - RNA, 19 nt, artificial
  Completely synthesized
guagucucaaccagcuugu

SEQ ID NO: 779 - RNA, 19 nt, artificial
  Completely synthesized
uaucuugccuccaaaguau

SEQ ID NO: 780 - RNA, 19 nt, artificial
  Completely synthesized
cuugccuccaaaguauguc

SEQ ID NO: 781 - RNA, 19 nt, artificial
  Completely synthesized
aacagaaguuucaggugac

SEQ ID NO: 782 - RNA, 19 nt, artificial
  Completely synthesized
augaagacugggcucucga

SEQ ID NO: 783 - RNA, 19 nt, artificial
  Completely synthesized
caugcagucaucaaaguac

SEQ ID NO: 784 - RNA, 19 nt, artificial
  Completely synthesized
augcagucaucaaaguaca

SEQ ID NO: 785 - RNA, 19 nt, artificial
  Completely synthesized
gucaaucaaauccaugucc

SEQ ID NO: 786 - RNA, 19 nt, artificial
  Completely synthesized
caucaaaguacaaagcauc

SEQ ID NO: 787 - RNA, 19 nt, artificial
  Completely synthesized
aaaguacaaagcaucugau

SEQ ID NO: 788 - RNA, 19 nt, artificial
  Completely synthesized
aaagcaucugauuugggaa

SEQ ID NO: 789 - RNA, 19 nt, artificial
  Completely synthesized
agcaucugauuugggaaug

SEQ ID NO: 790 - RNA, 19 nt, artificial
  Completely synthesized
aucugauuugggaaugugg

SEQ ID NO: 791 - RNA, 19 nt, artificial
  Completely synthesized
ucuucaucuaguuguaacu

SEQ ID NO: 792 - RNA, 19 nt, artificial
  Completely synthesized
augccauuuuuuguccaua

SEQ ID NO: 793 - RNA, 19 nt, artificial
  Completely synthesized
cauuuuuuguccauacagu

SEQ ID NO: 794 - RNA, 19 nt, artificial
  Completely synthesized
uuuuuagccagaugucaua

SEQ ID NO: 795 - RNA, 19 nt, artificial
  Completely synthesized
caaaugacauaagaacagu

SEQ ID NO: 796 - RNA, 19 nt, artificial
  Completely synthesized
uacacuuacacagaaacua

SEQ ID NO: 797 - RNA, 19 nt, artificial
  Completely synthesized
acuuacacagaaacuagcc

SEQ ID NO: 798 - RNA, 19 nt, artificial
  Completely synthesized
augguguccuaagaaauug

SEQ ID NO: 799 - RNA, 19 nt, artificial
  Completely synthesized
aacuacugauucaacauac

SEQ ID NO: 800 - RNA, 19 nt, artificial
  Completely synthesized
uacugauucaacauacuga

SEQ ID NO: 801 - RNA, 19 nt, artificial
  Completely synthesized
guaugagcauuucacauca

SEQ ID NO: 802 - RNA, 19 nt, artificial
  Completely synthesized
acaucacaguaggagcuuu

SEQ ID NO: 803 - RNA, 19 nt, artificial
  Completely synthesized
acaguaggagcuuuuagua

SEQ ID NO: 804 - RNA, 19 nt, artificial
  Completely synthesized
cucagaaaaggucaaaucc

SEQ ID NO: 805 - RNA, 19 nt, artificial
  Completely synthesized
ggaaaacauugccaucucu

SEQ ID NO: 806 - RNA, 19 nt, artificial
  Completely synthesized
acauugccaucucuuguuu

SEQ ID NO: 807 - RNA, 19 nt, artificial
  Completely synthesized
ugccaucucuuguuugcug

SEQ ID NO: 808 - RNA, 19 nt, artificial
  Completely synthesized
ugcagggaguauucacuag

SEQ ID NO: 809 - RNA, 19 nt, artificial
  Completely synthesized
gaauaagguuuuccaucuu

SEQ ID NO: 810 - RNA, 19 nt, artificial
  Completely synthesized
uucaucacguagcaugcug

SEQ ID NO: 811 - RNA, 19 nt, artificial
  Completely synthesized
aacuucgagauauaaggug

SEQ ID NO: 812 - RNA, 19 nt, artificial
  Completely synthesized
ucgagauauaaggugcuga

SEQ ID NO: 813 - RNA, 19 nt, artificial
  Completely synthesized
ugcucuaguucuacuauau

SEQ ID NO: 814 - RNA, 19 nt, artificial
  Completely synthesized
caguuuucuuuuucugcaa

SEQ ID NO: 815 - RNA, 19 nt, artificial
  Completely synthesized
ucuuuggacaucauuucgu

SEQ ID NO: 816 - RNA, 19 nt, artificial
  Completely synthesized
aagucaacaacagggaggu

SEQ ID NO: 817 - RNA, 19 nt, artificial
  Completely synthesized
aaugauuuuuucuacaggg

SEQ ID NO: 818 - RNA, 19 nt, artificial
  Completely synthesized
uuugcccuaaguucaucuc

SEQ ID NO: 819 - RNA, 19 nt, artificial
  Completely synthesized
ccuaaguucaucucuugug

SEQ ID NO: 820 - RNA, 19 nt, artificial
  Completely synthesized
gucuuuugugaaugggguu

SEQ ID NO: 821 - RNA, 19 nt, artificial
  Completely synthesized
ucuuucucugguguguucu

SEQ ID NO: 822 - RNA, 19 nt, artificial
  Completely synthesized
uaggaccauucuguuugac

SEQ ID NO: 823 - RNA, 19 nt, artificial
  Completely synthesized
cauucuguuugacacuucc

SEQ ID NO: 824 - RNA, 19 nt, artificial
  Completely synthesized
auucuguuugacacuucca

SEQ ID NO: 825 - RNA, 19 nt, artificial
  Completely synthesized
cuguuugacacuuccaggg

SEQ ID NO: 826 - RNA, 19 nt, artificial
  Completely synthesized
cacuaucuagcucuuccac

SEQ ID NO: 827 - RNA, 19 nt, artificial
  Completely synthesized
uuccacugaguguucuggu

SEQ ID NO: 828 - RNA, 19 nt, artificial
  Completely synthesized
cauacucuuuccgucgcug

SEQ ID NO: 829 - RNA, 19 nt, artificial
  Completely synthesized
uuugcaaagugauagauca

SEQ ID NO: 830 - RNA, 19 nt, artificial
  Completely synthesized
aucagaaacaucaaugggc

SEQ ID NO: 831 - RNA, 19 nt, artificial
  Completely synthesized
accaaaaucuguguugacu

SEQ ID NO: 832 - RNA, 19 nt, artificial
  Completely synthesized
aaugaguucacugucaacu

SEQ ID NO: 833 - RNA, 19 nt, artificial
  Completely synthesized
agaaaauguggacuacagu

SEQ ID NO: 834 - RNA, 19 nt, artificial
  Completely synthesized
ccuacuucuuuuuccauug

SEQ ID NO: 835 - RNA, 19 nt, artificial
  Completely synthesized
gucaacuucugucaguuug

SEQ ID NO: 836 - RNA, 19 nt, artificial
  Completely synthesized
cuuggaaccaugguagucu

SEQ ID NO: 837 - RNA, 19 nt, artificial
  Completely synthesized
aacuugcucaauguccugu

SEQ ID NO: 838 - RNA, 19 nt, artificial
  Completely synthesized
uugccuccaaaguauguca

SEQ ID NO: 839 - RNA, 19 nt, artificial
  Completely synthesized
gaacaagugacugaaacgu

SEQ ID NO: 840 - RNA, 19 nt, artificial
  Completely synthesized
acaagugacugaaacguag

SEQ ID NO: 841 - RNA, 19 nt, artificial
  Completely synthesized
aagugacugaaacguagcc

SEQ ID NO: 842 - RNA, 19 nt, artificial
  Completely synthesized
aaguaugucaaucaaaucc

SEQ ID NO: 843 - RNA, 19 nt, artificial
  Completely synthesized
acugaaacguagccgaaga

SEQ ID NO: 844 - RNA, 19 nt, artificial
  Completely synthesized
auccacugguuucugacug

SEQ ID NO: 845 - RNA, 19 nt, artificial
  Completely synthesized
aaauucaccugucucuuca

SEQ ID NO: 846 - RNA, 19 nt, artificial
  Completely synthesized
ucaccugucucuucaucua

SEQ ID NO: 847 - RNA, 19 nt, artificial
  Completely synthesized
uuauuaguaccagcucuua

SEQ ID NO: 848 - RNA, 19 nt, artificial
  Completely synthesized
ccauuuuuuguccauacag

SEQ ID NO: 849 - RNA, 19 nt, artificial
  Completely synthesized
ucaacauacugacacucca

SEQ ID NO: 850 - RNA, 19 nt, artificial
  Completely synthesized
aaaguaugagcauuucaca

SEQ ID NO: 851 - RNA, 19 nt, artificial
  Completely synthesized
uaugagcauuucacaucac

SEQ ID NO: 852 - RNA, 19 nt, artificial
  Completely synthesized
ucacaucacaguaggagcu

SEQ ID NO: 853 - RNA, 19 nt, artificial
  Completely synthesized
cagggaguauucacuagga

SEQ ID NO: 854 - RNA, 19 nt, artificial
  Completely synthesized
ggaguauucacuaggagaa

SEQ ID NO: 855 - RNA, 19 nt, artificial
  Completely synthesized
aucuucaucacguagcaug

SEQ ID NO: 856 - RNA, 19 nt, artificial
  Completely synthesized
ucuucaucacguagcaugc

SEQ ID NO: 857 - RNA, 19 nt, artificial
  Completely synthesized
cuucgagauauaaggugcu

SEQ ID NO: 858 - RNA, 19 nt, artificial
  Completely synthesized
gucauuuucuccuuuuucu

SEQ ID NO: 859 - RNA, 19 nt, artificial
  Completely synthesized
ccaguuuucuuuuucugca

SEQ ID NO: 860 - RNA, 19 nt, artificial
  Completely synthesized
acaacagggagguuaauga

SEQ ID NO: 861 - RNA, 19 nt, artificial
  Completely synthesized
accauucuguuugacacuu

SEQ ID NO: 862 - RNA, 19 nt, artificial
  Completely synthesized
uuccagcucauacucuuuc

SEQ ID NO: 863 - RNA, 19 nt, artificial
  Completely synthesized
uugaauucugcugugcuuu

SEQ ID NO: 864 - RNA, 19 nt, artificial
  Completely synthesized
agugauagaucagaaacau

SEQ ID NO: 865 - RNA, 19 nt, artificial
  Completely synthesized
agaaacaucaaugggccca

SEQ ID NO: 866 - RNA, 19 nt, artificial
  Completely synthesized
ccaaaaucuguguugacug

SEQ ID NO: 867 - RNA, 19 nt, artificial
  Completely synthesized
caaaaucuguguugacugu

SEQ ID NO: 868 - RNA, 19 nt, artificial
  Completely synthesized
aaaaucuguguugacugug

SEQ ID NO: 869 - RNA, 19 nt, artificial
  Completely synthesized
acugguuggggucuucugu

SEQ ID NO: 870 - RNA, 19 nt, artificial
  Completely synthesized
augcugcugaaggaauccu

SEQ ID NO: 871 - RNA, 19 nt, artificial
  Completely synthesized
accuacuucuuuuuccauu

SEQ ID NO: 872 - RNA, 19 nt, artificial
  Completely synthesized
gucucaaccagcuugucau

SEQ ID NO: 873 - RNA, 19 nt, artificial
  Completely synthesized
uccucccaaacuugcucaa

SEQ ID NO: 874 - RNA, 19 nt, artificial
  Completely synthesized
ugagcaacagaaguuucag

SEQ ID NO: 875 - RNA, 19 nt, artificial
  Completely synthesized
caacagaaguuucagguga

SEQ ID NO: 876 - RNA, 19 nt, artificial
  Completely synthesized
ugccuccaaaguaugucaa

SEQ ID NO: 877 - RNA, 19 nt, artificial
  Completely synthesized
cuccaaaguaugucaauca

SEQ ID NO: 878 - RNA, 19 nt, artificial
  Completely synthesized
aacguagccgaagaaaccu

SEQ ID NO: 879 - RNA, 19 nt, artificial
  Completely synthesized
guaugucaaucaaauccau

SEQ ID NO: 880 - RNA, 19 nt, artificial
  Completely synthesized
augucaaucaaauccaugu

SEQ ID NO: 881 - RNA, 19 nt, artificial
  Completely synthesized
gcuggcugaauugggagaa

SEQ ID NO: 882 - RNA, 19 nt, artificial
  Completely synthesized
agaaauucaccugucucuu

SEQ ID NO: 883 - RNA, 19 nt, artificial
  Completely synthesized
auucaccugucucuucauc

SEQ ID NO: 884 - RNA, 19 nt, artificial
  Completely synthesized
ccugucucuucaucuaguu

SEQ ID NO: 885 - RNA, 19 nt, artificial
  Completely synthesized
auagugguuaguuuugcaa

SEQ ID NO: 886 - RNA, 19 nt, artificial
  Completely synthesized
ucuuuuuagccagauguca

SEQ ID NO: 887 - RNA, 19 nt, artificial
  Completely synthesized
auucaacauacugacacuc

SEQ ID NO: 888 - RNA, 19 nt, artificial
  Completely synthesized
uacugacacuccaaugcuu

SEQ ID NO: 889 - RNA, 19 nt, artificial
  Completely synthesized
uucacaucacaguaggagc

SEQ ID NO: 890 - RNA, 19 nt, artificial
  Completely synthesized
aacuagcucagaaaagguc

SEQ ID NO: 891 - RNA, 19 nt, artificial
  Completely synthesized
acuagcucagaaaagguca

SEQ ID NO: 892 - RNA, 19 nt, artificial
  Completely synthesized
agcuccaaguccaucauga

SEQ ID NO: 893 - RNA, 19 nt, artificial
  Completely synthesized
aaaacuucgagauauaagg

SEQ ID NO: 894 - RNA, 19 nt, artificial
  Completely synthesized
cgagauauaaggugcugag

SEQ ID NO: 895 - RNA, 19 nt, artificial
  Completely synthesized
uuuuggaguuguucuuguc

SEQ ID NO: 896 - RNA, 19 nt, artificial
  Completely synthesized
ccuccuacguauaucccga

SEQ ID NO: 897 - RNA, 19 nt, artificial
  Completely synthesized
cuacguauaucccgaauua

SEQ ID NO: 898 - RNA, 19 nt, artificial
  Completely synthesized
gcucuuuggacaucauuuc

SEQ ID NO: 899 - RNA, 19 nt, artificial
  Completely synthesized
cuuuggacaucauuucguu

SEQ ID NO: 900 - RNA, 19 nt, artificial
  Completely synthesized
ggagguuaaugauuuuuuc

SEQ ID NO: 901 - RNA, 19 nt, artificial
  Completely synthesized
gaaugggauauggagagcu

SEQ ID NO: 902 - RNA, 19 nt, artificial
  Completely synthesized
ggauauggagagcuuuugc

SEQ ID NO: 903 - RNA, 19 nt, artificial
  Completely synthesized
ugcccuaaguucaucucuu

SEQ ID NO: 904 - RNA, 19 nt, artificial
  Completely synthesized
guuuuuucuguuuuuccag

SEQ ID NO: 905 - RNA, 19 nt, artificial
  Completely synthesized
uuuucuguuuuuccagcuc

SEQ ID NO: 906 - RNA, 19 nt, artificial
  Completely synthesized
uguuugacacuuccagggg

SEQ ID NO: 907 - RNA, 19 nt, artificial
  Completely synthesized
agcucuuccacuucagaau

SEQ ID NO: 908 - RNA, 19 nt, artificial
  Completely synthesized
acugaguguucuggugaug

SEQ ID NO: 909 - RNA, 19 nt, artificial
  Completely synthesized
uugcaaagugauagaucag

SEQ ID NO: 910 - RNA, 19 nt, artificial
  Completely synthesized
ugcaaagugauagaucaga

SEQ ID NO: 911 - RNA, 19 nt, artificial
  Completely synthesized
gcaaagugauagaucagaa

SEQ ID NO: 912 - RNA, 19 nt, artificial
  Completely synthesized
uguugcugauacugggcuc

SEQ ID NO: 913 - RNA, 19 nt, artificial
  Completely synthesized
gacuacaguuaccuacuuc

SEQ ID NO: 914 - RNA, 19 nt, artificial
  Completely synthesized
acuacaguuaccuacuucu

SEQ ID NO: 915 - RNA, 19 nt, artificial
  Completely synthesized
acaguuaccuacuucuuuu

SEQ ID NO: 916 - RNA, 19 nt, artificial
  Completely synthesized
uugcucaauguccuguugc

SEQ ID NO: 917 - RNA, 19 nt, artificial
  Completely synthesized
ggaauaucaggaacaagug

SEQ ID NO: 918 - RNA, 19 nt, artificial
  Completely synthesized
aaucaaauccauguccugc

SEQ ID NO: 919 - RNA, 19 nt, artificial
  Completely synthesized
uuuacacuuacacagaaac

SEQ ID NO: 920 - RNA, 19 nt, artificial
  Completely synthesized
cauacugacacuccaaugc

SEQ ID NO: 921 - RNA, 19 nt, artificial
  Completely synthesized
augagcauuucacaucaca

SEQ ID NO: 922 - RNA, 19 nt, artificial
  Completely synthesized
aaauccuccuaaaucuagu

SEQ ID NO: 923 - RNA, 19 nt, artificial
  Completely synthesized
gcaugcugaaaacuucgag

SEQ ID NO: 924 - RNA, 19 nt, artificial
  Completely synthesized
augcugaaaacuucgagau

SEQ ID NO: 925 - RNA, 19 nt, artificial
  Completely synthesized
uccaguuuucuuuuucugc

SEQ ID NO: 926 - RNA, 19 nt, artificial
  Completely synthesized
accccuccuacguauaucc

SEQ ID NO: 927 - RNA, 19 nt, artificial
  Completely synthesized
uuggaguuguucuugucuu

SEQ ID NO: 928 - RNA, 19 nt, artificial
  Completely synthesized
cuucauugaacugcucuuu

SEQ ID NO: 929 - RNA, 19 nt, artificial
  Completely synthesized
uuggacaucauuucguuga

SEQ ID NO: 930 - RNA, 19 nt, artificial
  Completely synthesized
gucaacaacagggagguua

SEQ ID NO: 931 - RNA, 19 nt, artificial
  Completely synthesized
gggauauggagagcuuuug

SEQ ID NO: 932 - RNA, 19 nt, artificial
  Completely synthesized
uuuugcccuaaguucaucu

SEQ ID NO: 933 - RNA, 19 nt, artificial
  Completely synthesized
uugcccuaaguucaucucu

SEQ ID NO: 934 - RNA, 19 nt, artificial
  Completely synthesized
uuuuucuguuuuuccagcu

SEQ ID NO: 935 - RNA, 19 nt, artificial
  Completely synthesized
auguacugguguuuuagga

SEQ ID NO: 936 - RNA, 19 nt, artificial
  Completely synthesized
ugauagaucagaaacauca

SEQ ID NO: 937 - RNA, 19 nt, artificial
  Completely synthesized
agaucagaaacaucaaugg

SEQ ID NO: 938 - RNA, 19 nt, artificial
  Completely synthesized
acuacugauucaacauacu

SEQ ID NO: 939 - RNA, 19 nt, artificial
  Completely synthesized
caaaaaaacuagcucagaa

SEQ ID NO: 940 - RNA, 19 nt, artificial
  Completely synthesized
agcaugcugaaaacuucga

SEQ ID NO: 941 - RNA, 19 nt, artificial
  Completely synthesized
uccuacguauaucccgaau

SEQ ID NO: 942 - RNA, 19 nt, artificial
  Completely synthesized
uugaacugcucuuuggaca

SEQ ID NO: 943 - RNA, 19 nt, artificial
  Completely synthesized
uuguaccauauccccagaa

SEQ ID NO: 944 - RNA, 19 nt, artificial
  Completely synthesized
uguaccauauccccagaag

SEQ ID NO: 945 - RNA, 19 nt, artificial
  Completely synthesized
aagugauagaucagaaaca

SEQ ID NO: 946 - RNA, 19 nt, artificial
  Completely synthesized
auggcuuaaaguagcaggu

SEQ ID NO: 947 - RNA, 19 nt, artificial
  Completely synthesized
aggaacaagugacugaaac

SEQ ID NO: 948 - RNA, 19 nt, artificial
  Completely synthesized
ugguuucugacuggaugug

SEQ ID NO: 949 - RNA, 19 nt, artificial
  Completely synthesized
aauccuuuauuaguaccag

SEQ ID NO: 950 - RNA, 19 nt, artificial
  Completely synthesized
gauucaacauacugacacu

SEQ ID NO: 951 - RNA, 19 nt, artificial
  Completely synthesized
auccuccuaaaucuaguuu

SEQ ID NO: 952 - RNA, 19 nt, artificial
  Completely synthesized
uccuccuaaaucuaguuuu

SEQ ID NO: 953 - RNA, 19 nt, artificial
  Completely synthesized
aauuaaugcaaguugagcu

SEQ ID NO: 954 - RNA, 19 nt, artificial
  Completely synthesized
gcuucauugaacugcucuu

SEQ ID NO: 955 - RNA, 19 nt, artificial
  Completely synthesized
aacugcucuuuggacauca

SEQ ID NO: 956 - RNA, 19 nt, artificial
  Completely synthesized
uuuugugaaugggguuuuc

SEQ ID NO: 957 - RNA, 19 nt, artificial
  Completely synthesized
uuucuguuuuuccagcuca

SEQ ID NO: 958 - RNA, 19 nt, artificial
  Completely synthesized
gauagaucagaaacaucaa

SEQ ID NO: 959 - RNA, 19 nt, artificial
  Completely synthesized
gauuugggaaugugggcaa

SEQ ID NO: 960 - RNA, 19 nt, artificial
  Completely synthesized
gguuucugacuggaugugc

SEQ ID NO: 961 - RNA, 19 nt, artificial
  Completely synthesized
auccuuuauuaguaccagc

SEQ ID NO: 962 - RNA, 19 nt, artificial
  Completely synthesized
uucaacauacugacacucc

SEQ ID NO: 963 - RNA, 19 nt, artificial
  Completely synthesized
aaaacuagcucagaaaagg

SEQ ID NO: 964 - RNA, 19 nt, artificial
  Completely synthesized
uuucuccuuuuucuuugag

SEQ ID NO: 965 - RNA, 19 nt, artificial
  Completely synthesized
uuuggaguuguucuugucu

SEQ ID NO: 966 - RNA, 19 nt, artificial
  Completely synthesized
acugcucuuuggacaucau

SEQ ID NO: 967 - RNA, 19 nt, artificial
  Completely synthesized
uucuguuuuuccagcucau

SEQ ID NO: 968 - RNA, 19 nt, artificial
  Completely synthesized
uguacugguguuuuaggac

SEQ ID NO: 969 - RNA, 19 nt, artificial
  Completely synthesized
agggcaugcuguugcugau

SEQ ID NO: 970 - RNA, 19 nt, artificial
  Completely synthesized
acuucugucaguuuggcuu

SEQ ID NO: 971 - RNA, 19 nt, artificial
  Completely synthesized
ucauugucaucuacaaacg

SEQ ID NO: 972 - RNA, 19 nt, artificial
  Completely synthesized
auuugggaaugugggcaac

SEQ ID NO: 973 - RNA, 19 nt, artificial
  Completely synthesized
auugccaucucuuguuugc

SEQ ID NO: 974 - RNA, 19 nt, artificial
  Completely synthesized
uccuuuuucuuugagcaau

SEQ ID NO: 975 - RNA, 19 nt, artificial
  Completely synthesized
ucuuuugugaaugggguuu

SEQ ID NO: 976 - RNA, 19 nt, artificial
  Completely synthesized
cuaucuagcucuuccacuu

SEQ ID NO: 977 - RNA, 19 nt, artificial
  Completely synthesized
ugggacuuguguuuaguga

SEQ ID NO: 978 - RNA, 19 nt, artificial
  Completely synthesized
uguguuuagugaaaugccg

SEQ ID NO: 979 - RNA, 19 nt, artificial
  Completely synthesized
agagagugaauggcuuaaa

SEQ ID NO: 980 - RNA, 19 nt, artificial
  Completely synthesized
uggcuuaaaguagcaggug

SEQ ID NO: 981 - RNA, 19 nt, artificial
  Completely synthesized
aauggauaauagcuccucc

SEQ ID NO: 982 - RNA, 19 nt, artificial
  Completely synthesized
auggauaauagcuccuccc

SEQ ID NO: 983 - RNA, 19 nt, artificial
  Completely synthesized
ucuaguuguaacugagcga

SEQ ID NO: 984 - RNA, 19 nt, artificial
  Completely synthesized
auaagguuuuccaucuuca

SEQ ID NO: 985 - RNA, 19 nt, artificial
  Completely synthesized
auuaaugcaaguugagcuu

SEQ ID NO: 986 - RNA, 19 nt, artificial
  Completely synthesized
cuuuugugaaugggguuuu

SEQ ID NO: 987 - RNA, 19 nt, artificial
  Completely synthesized
aguagugugucuccauagc

SEQ ID NO: 988 - RNA, 19 nt, artificial
  Completely synthesized
gcugacugaagucaaauac

SEQ ID NO: 989 - RNA, 19 nt, artificial
  Completely synthesized
aauggcuuaaaguagcagg

SEQ ID NO: 990 - RNA, 19 nt, artificial
  Completely synthesized
guugcugauacugggcuca

SEQ ID NO: 991 - RNA, 19 nt, artificial
  Completely synthesized
cugaagucaaauacuucuc

SEQ ID NO: 992 - RNA, 19 nt, artificial
  Completely synthesized
uuaccuacuucuuuuucca

SEQ ID NO: 993 - RNA, 19 nt, artificial
  Completely synthesized
cuucugucaguuuggcuuc

SEQ ID NO: 994 - RNA, 19 nt, artificial
  Completely synthesized
ucugucaguuuggcuucug

SEQ ID NO: 995 - RNA, 19 nt, artificial
  Completely synthesized
caaccagcuugucauuuuc

SEQ ID NO: 996 - RNA, 19 nt, artificial
  Completely synthesized
ugacacuccaaugcuuuuu

SEQ ID NO: 997 - RNA, 19 nt, artificial
  Completely synthesized
aaaaggucaaauccuccua

SEQ ID NO: 998 - RNA, 19 nt, artificial
  Completely synthesized
agaauaagguuuuccaucu

SEQ ID NO: 999 - RNA, 19 nt, artificial
  Completely synthesized
uuaaugcaaguugagcuuc

SEQ ID NO: 1000 - RNA, 19 nt, artificial
  Completely synthesized
ggaaugggauauggagagc

SEQ ID NO: 1001 - RNA, 19 nt, artificial
  Completely synthesized
uuugugaaugggguuuucc

SEQ ID NO: 1002 - RNA, 19 nt, artificial
  Completely synthesized
ucaugcacgugagugcucu

SEQ ID NO: 1003 - RNA, 19 nt, artificial
  Completely synthesized
cugagauggugacaagggu

SEQ ID NO: 1004 - RNA, 19 nt, artificial
  Completely synthesized
aaucacugaggccaaguag

SEQ ID NO: 1005 - RNA, 19 nt, artificial
  Completely synthesized
cugaauuuaaugaguucac

SEQ ID NO: 1006 - RNA, 19 nt, artificial
  Completely synthesized
guuaccuacuucuuuuucc

SEQ ID NO: 1007 - RNA, 19 nt, artificial
  Completely synthesized
aaugauuuuuucgacaggg

SEQ ID NO: 1008 - RNA, 19 nt, artificial
  Completely synthesized
augauuuuuucgacaggga

SEQ ID NO: 1009 - RNA, 19 nt, Artificial
  Completely synthesized
uaaugauuuuuucgacagg

SEQ ID NO: 1010 - RNA, 21 nt, artificial
  Completely synthesized
uaggagggguaagaauaaagu

SEQ ID NO: 1011 - RNA, 21 nt, artificial
  Completely synthesized
agggguaagaauaaaguggcu

SEQ ID NO: 1012 - RNA, 21 nt, artificial
  Completely synthesized
aagaagccagauguuaagaaa

SEQ ID NO: 1013 - RNA, 21 nt, artificial
  Completely synthesized
aaaggagaaaaugacaaaagc

SEQ ID NO: 1014 - RNA, 21 nt, artificial
  Completely synthesized
gagggguaagaauaaaguggc

SEQ ID NO: 1015 - RNA, 21 nt, artificial
  Completely synthesized
guaggagggguaagaauaaag

SEQ ID NO: 1016 - RNA, 21 nt, artificial
  Completely synthesized
auaaaguggcugcucagaauu

SEQ ID NO: 1017 - RNA, 21 nt, artificial
  Completely synthesized
aggagggguaagaauaaagug

SEQ ID NO: 1018 - RNA, 21 nt, artificial
  Completely synthesized
gagaaagaauugccuguaagu

SEQ ID NO: 1019 - RNA, 21 nt, artificial
  Completely synthesized
ucacucucugaacuucuaaau

SEQ ID NO: 1020 - RNA, 21 nt, artificial
  Completely synthesized
gacauucccguuuguagauga

SEQ ID NO: 1021 - RNA, 21 nt, artificial
  Completely synthesized
agaagccagauguuaagaaaa

SEQ ID NO: 1022 - RNA, 21 nt, artificial
  Completely synthesized
cucagaauugcagaaaaagaa

SEQ ID NO: 1023 - RNA, 21 nt, artificial
  Completely synthesized
aagaauaaaguggcugcucag

SEQ ID NO: 1024 - RNA, 21 nt, artificial
  Completely synthesized
ggguaagaauaaaguggcugc

SEQ ID NO: 1025 - RNA, 21 nt, artificial
  Completely synthesized
ugaaaaggaaagacaagaaca

SEQ ID NO: 1026 - RNA, 21 nt, artificial
  Completely synthesized
gcccucaccugcuacuuuaag

SEQ ID NO: 1027 - RNA, 21 nt, artificial
  Completely synthesized
guagaugacaaugagguuucu

SEQ ID NO: 1028 - RNA, 21 nt, artificial
  Completely synthesized
guaagaagccagauguuaaga

SEQ ID NO: 1029 - RNA, 21 nt, artificial
  Completely synthesized
aaguaagaagccagauguuaa

SEQ ID NO: 1030 - RNA, 21 nt, artificial
  Completely synthesized
gggguaagaauaaaguggcug

SEQ ID NO: 1031 - RNA, 21 nt, artificial
  Completely synthesized
agagaaagaauugccuguaag

SEQ ID NO: 1032 - RNA, 21 nt, artificial
  Completely synthesized
cucucugaacuucuaaauggg

SEQ ID NO: 1033 - RNA, 21 nt, artificial
  Completely synthesized
uuacucaucuauacccucaau

SEQ ID NO: 1034 - RNA, 21 nt, artificial
  Completely synthesized
ccagucuucauugcuacuaau

SEQ ID NO: 1035 - RNA, 21 nt, artificial
  Completely synthesized
uagaugacaaugagguuucuu

SEQ ID NO: 1036 - RNA, 21 nt, artificial
  Completely synthesized
acauucccguuuguagaugac

SEQ ID NO: 1037 - RNA, 21 nt, artificial
  Completely synthesized
gcaaaacuaaccacuauguac

SEQ ID NO: 1038 - RNA, 21 nt, artificial
  Completely synthesized
aaaaguaagaagccagauguu

SEQ ID NO: 1039 - RNA, 21 nt, artificial
  Completely synthesized
cccaaaaguaagaagccagau

SEQ ID NO: 1040 - RNA, 21 nt, artificial
  Completely synthesized
uugcucaaagaaaaaggagaa

SEQ ID NO: 1041 - RNA, 21 nt, artificial
  Completely synthesized
gaacuagagcaagauuuagau

SEQ ID NO: 1042 - RNA, 21 nt, artificial
  Completely synthesized
gcucagaauugcagaaaaaga

SEQ ID NO: 1043 - RNA, 21 nt, artificial
  Completely synthesized
uugaaaaggaaagacaagaac

SEQ ID NO: 1044 - RNA, 21 nt, artificial
  Completely synthesized
agaacacaccagagaaagaau

SEQ ID NO: 1045 - RNA, 21 nt, artificial
  Completely synthesized
aaaacaccaguacauucuucu

SEQ ID NO: 1046 - RNA, 21 nt, artificial
  Completely synthesized
gucaaacagaaugguccuaaa

SEQ ID NO: 1047 - RNA, 21 nt, artificial
  Completely synthesized
aaccaaaaccacccugaaagc

SEQ ID NO: 1048 - RNA, 21 nt, artificial
  Completely synthesized
uucaaccaaaaccacccugaa

SEQ ID NO: 1049 - RNA, 21 nt, artificial
  Completely synthesized
cacucucugaacuucuaaaug

SEQ ID NO: 1050 - RNA, 21 nt, artificial
  Completely synthesized
gaguaagucgagaaguauuug

SEQ ID NO: 1051 - RNA, 21 nt, artificial
  Completely synthesized
gacaaugagguuucuucggcu

SEQ ID NO: 1052 - RNA, 21 nt, artificial
  Completely synthesized
ucagaugcuuuguacuuugau

SEQ ID NO: 1053 - RNA, 21 nt, artificial
  Completely synthesized
gacaucuggcuaaaaagaaau

SEQ ID NO: 1054 - RNA, 21 nt, artificial
  Completely synthesized
gaagccagauguuaagaaaaa

SEQ ID NO: 1055 - RNA, 21 nt, artificial
  Completely synthesized
caaaaguaagaagccagaugu

SEQ ID NO: 1056 - RNA, 21 nt, artificial
  Completely synthesized
aaaaccuuauucuccuaguga

SEQ ID NO: 1057 - RNA, 21 nt, artificial
  Completely synthesized
acguaggagggguaagaauaa

SEQ ID NO: 1058 - RNA, 21 nt, artificial
  Completely synthesized
aaggaaagacaagaacaacuc

SEQ ID NO: 1059 - RNA, 21 nt, artificial
  Completely synthesized
cacaaaagacaaacauucaag

SEQ ID NO: 1060 - RNA, 21 nt, artificial
  Completely synthesized
cccauucacaaaagacaaaca

SEQ ID NO: 1061 - RNA, 21 nt, artificial
  Completely synthesized
aaccccauucacaaaagacaa

SEQ ID NO: 1062 - RNA, 21 nt, artificial
  Completely synthesized
acaccagagaaagaauugccu

SEQ ID NO: 1063 - RNA, 21 nt, artificial
  Completely synthesized
aacacaccagagaaagaauug

SEQ ID NO: 1064 - RNA, 21 nt, artificial
  Completely synthesized
ucaaacagaaugguccuaaaa

SEQ ID NO: 1065 - RNA, 21 nt, artificial
  Completely synthesized
ucagcgacggaaagaguauga

SEQ ID NO: 1066 - RNA, 21 nt, artificial
  Completely synthesized
gcacagcagaauucaaugauu

SEQ ID NO: 1067 - RNA, 21 nt, artificial
  Completely synthesized
gcuuucaaccaaaaccacccu

SEQ ID NO: 1068 - RNA, 21 nt, artificial
  Completely synthesized
gccacagucaacacagauuuu

SEQ ID NO: 1069 - RNA, 21 nt, artificial
  Completely synthesized
aacucauuaaauucagaugcc

SEQ ID NO: 1070 - RNA, 21 nt, artificial
  Completely synthesized
guugacagugaacucauuaaa

SEQ ID NO: 1071 - RNA, 21 nt, artificial
  Completely synthesized
gcuauuauccauuccugaguu

SEQ ID NO: 1072 - RNA, 21 nt, artificial
  Completely synthesized
aaguuugggaggagcuauuau

SEQ ID NO: 1073 - RNA, 21 nt, artificial
  Completely synthesized
caaguuugggaggagcuauua

SEQ ID NO: 1074 - RNA, 21 nt, artificial
  Completely synthesized
gucuucauugcuacuaaucag

SEQ ID NO: 1075 - RNA, 21 nt, artificial
  Completely synthesized
gaugacaaugagguuucuucg

SEQ ID NO: 1076 - RNA, 21 nt, artificial
  Completely synthesized
aucagaugcuuuguacuuuga

SEQ ID NO: 1077 - RNA, 21 nt, artificial
  Completely synthesized
gcccacauucccaaaucagau

SEQ ID NO: 1078 - RNA, 21 nt, artificial
  Completely synthesized
gugaugugaaaugcucauacu

SEQ ID NO: 1079 - RNA, 21 nt, artificial
  Completely synthesized
aagcuccuacugugaugugaa

SEQ ID NO: 1080 - RNA, 21 nt, artificial
  Completely synthesized
cuacgugaugaagauggaaaa

SEQ ID NO: 1081 - RNA, 21 nt, artificial
  Completely synthesized
augcuacgugaugaagaugga

SEQ ID NO: 1082 - RNA, 21 nt, artificial
  Completely synthesized
ugaaaaaacaacucagcaccu

SEQ ID NO: 1083 - RNA, 21 nt, artificial
  Completely synthesized
ucaccuacugaaaaaacaacu

SEQ ID NO: 1084 - RNA, 21 nt, artificial
  Completely synthesized
guagaacuagagcaagauuua

SEQ ID NO: 1085 - RNA, 21 nt, artificial
  Completely synthesized
ucaacuugcauuaauucggga

SEQ ID NO: 1086 - RNA, 21 nt, artificial
  Completely synthesized
aaaggaaagacaagaacaacu

SEQ ID NO: 1087 - RNA, 21 nt, artificial
  Completely synthesized
ccauucacaaaagacaaacau

SEQ ID NO: 1088 - RNA, 21 nt, artificial
  Completely synthesized
cacaccagagaaagaauugcc

SEQ ID NO: 1089 - RNA, 21 nt, artificial
  Completely synthesized
aacagaaugguccuaaaacac

SEQ ID NO: 1090 - RNA, 21 nt, artificial
  Completely synthesized
ggaaagaguaugagcuggaaa

SEQ ID NO: 1091 - RNA, 21 nt, artificial
  Completely synthesized
caguugacagugaacucauua

SEQ ID NO: 1092 - RNA, 21 nt, artificial
  Completely synthesized
ggaguaagucgagaaguauuu

SEQ ID NO: 1093 - RNA, 21 nt, artificial
  Completely synthesized
uggaguaagucgagaaguauu

SEQ ID NO: 1094 - RNA, 21 nt, artificial
  Completely synthesized
uuggaguaagucgagaaguau

SEQ ID NO: 1095 - RNA, 21 nt, artificial
  Completely synthesized
cuauuauccauuccugaguua

SEQ ID NO: 1096 - RNA, 21 nt, artificial
  Completely synthesized
gcaacaggacauugagcaagu

SEQ ID NO: 1097 - RNA, 21 nt, artificial
  Completely synthesized
guugauuuagacgguaugcaa

SEQ ID NO: 1098 - RNA, 21 nt, artificial
  Completely synthesized
cagucuucauugcuacuaauc

SEQ ID NO: 1099 - RNA, 21 nt, artificial
  Completely synthesized
ucacaucgagagcccagucuu

SEQ ID NO: 1100 - RNA, 21 nt, artificial
  Completely synthesized
aggacauggauuugauugaca

SEQ ID NO: 1101 - RNA, 21 nt, artificial
  Completely synthesized
ugcccacauucccaaaucaga

SEQ ID NO: 1102 - RNA, 21 nt, artificial
  Completely synthesized
uacucccagguugcccacauu

SEQ ID NO: 1103 - RNA, 21 nt, artificial
  Completely synthesized
aagagcugguacuaauaaagg

SEQ ID NO: 1104 - RNA, 21 nt, artificial
  Completely synthesized
uaagagcugguacuaauaaag

SEQ ID NO: 1105 - RNA, 21 nt, artificial
  Completely synthesized
cuguauggacaaaaaauggca

SEQ ID NO: 1106 - RNA, 21 nt, artificial
  Completely synthesized
ggauuugaccuuuucugagcu

SEQ ID NO: 1107 - RNA, 21 nt, artificial
  Completely synthesized
aaaccuuauucuccuagugaa

SEQ ID NO: 1108 - RNA, 21 nt, artificial
  Completely synthesized
aaaaaacaacucagcaccuua

SEQ ID NO: 1109 - RNA, 21 nt, artificial
  Completely synthesized
cuagagcaagauuuagaucau

SEQ ID NO: 1110 - RNA, 21 nt, artificial
  Completely synthesized
gcagaaaaagaaaacuggaaa

SEQ ID NO: 1111 - RNA, 21 nt, artificial
  Completely synthesized
aacuugcauuaauucgggaua

SEQ ID NO: 1112 - RNA, 21 nt, artificial
  Completely synthesized
caacuugcauuaauucgggau

SEQ ID NO: 1113 - RNA, 21 nt, artificial
  Completely synthesized
ccauaucccauucccuguaga

SEQ ID NO: 1114 - RNA, 21 nt, artificial
  Completely synthesized
acaaaagacaaacauucaagc

SEQ ID NO: 1115 - RNA, 21 nt, artificial
  Completely synthesized
accccauucacaaaagacaaa

SEQ ID NO: 1116 - RNA, 21 nt, artificial
  Completely synthesized
aagaauugccuguaaguccug

SEQ ID NO: 1117 - RNA, 21 nt, artificial
  Completely synthesized
aaagaauugccuguaaguccu

SEQ ID NO: 1118 - RNA, 21 nt, artificial
  Completely synthesized
gaacacaccagagaaagaauu

SEQ ID NO: 1119 - RNA, 21 nt, artificial
  Completely synthesized
agaguaugagcuggaaaaaca

SEQ ID NO: 1120 - RNA, 21 nt, artificial
  Completely synthesized
guaguccacauuuucuuaaug

SEQ ID NO: 1121 - RNA, 21 nt, artificial
  Completely synthesized
uacucaucuauacccucaaug

SEQ ID NO: 1122 - RNA, 21 nt, artificial
  Completely synthesized
caggacauugagcaaguuugg

SEQ ID NO: 1123 - RNA, 21 nt, artificial
  Completely synthesized
uucggcuacguuucagucacu

SEQ ID NO: 1124 - RNA, 21 nt, artificial
  Completely synthesized
acaaugagguuucuucggcua

SEQ ID NO: 1125 - RNA, 21 nt, artificial
  Completely synthesized
ggacauggauuugauugacau

SEQ ID NO: 1126 - RNA, 21 nt, artificial
  Completely synthesized
uacuguauggacaaaaaaugg

SEQ ID NO: 1127 - RNA, 21 nt, artificial
  Completely synthesized
aacaauuucuuaggacaccau

SEQ ID NO: 1128 - RNA, 21 nt, artificial
  Completely synthesized
cuguaaacaauuucuuaggac

SEQ ID NO: 1129 - RNA, 21 nt, artificial
  Completely synthesized
gaagauggaaaaccuuauucu

SEQ ID NO: 1130 - RNA, 21 nt, artificial
  Completely synthesized
uacgugaugaagauggaaaac

SEQ ID NO: 1131 - RNA, 21 nt, artificial
  Completely synthesized
agcaccuuauaucucgaaguu

SEQ ID NO: 1132 - RNA, 21 nt, artificial
  Completely synthesized
aaaacaacucagcaccuuaua

SEQ ID NO: 1133 - RNA, 21 nt, artificial
  Completely synthesized
gagcaagauuuagaucauuug

SEQ ID NO: 1134 - RNA, 21 nt, artificial
  Completely synthesized
agaacuagagcaagauuuaga

SEQ ID NO: 1135 - RNA, 21 nt, artificial
  Completely synthesized
uugcagaaaaagaaaacugga

SEQ ID NO: 1136 - RNA, 21 nt, artificial
  Completely synthesized
uccauaucccauucccuguag

SEQ ID NO: 1137 - RNA, 21 nt, artificial
  Completely synthesized
ccccauucacaaaagacaaac

SEQ ID NO: 1138 - RNA, 21 nt, artificial
  Completely synthesized
gagaacacaccagagaaagaa

SEQ ID NO: 1139 - RNA, 21 nt, artificial
  Completely synthesized
caguacauucuucuggggaua

SEQ ID NO: 1140 - RNA, 21 nt, artificial
  Completely synthesized
acggaaagaguaugagcugga

SEQ ID NO: 1141 - RNA, 21 nt, artificial
  Completely synthesized
cugacuccggcauuucacuaa

SEQ ID NO: 1142 - RNA, 21 nt, artificial
  Completely synthesized
agcacagcagaauucaaugau

SEQ ID NO: 1143 - RNA, 21 nt, artificial
  Completely synthesized
uaaauucagaugccacaguca

SEQ ID NO: 1144 - RNA, 21 nt, artificial
  Completely synthesized
cucauuaaauucagaugccac

SEQ ID NO: 1145 - RNA, 21 nt, artificial
  Completely synthesized
acuguaguccacauuuucuua

SEQ ID NO: 1146 - RNA, 21 nt, artificial
  Completely synthesized
ucaauggaaaaagaaguaggu

SEQ ID NO: 1147 - RNA, 21 nt, artificial
  Completely synthesized
gagcuauuauccauuccugag

SEQ ID NO: 1148 - RNA, 21 nt, artificial
  Completely synthesized
aacaggacauugagcaaguuu

SEQ ID NO: 1149 - RNA, 21 nt, artificial
  Completely synthesized
uuagacgguaugcaacaggac

SEQ ID NO: 1150 - RNA, 21 nt, artificial
  Completely synthesized
uuuagacgguaugcaacagga

SEQ ID NO: 1151 - RNA, 21 nt, artificial
  Completely synthesized
ugagguuucuucggcuacguu

SEQ ID NO: 1152 - RNA, 21 nt, artificial
  Completely synthesized
augagguuucuucggcuacgu

SEQ ID NO: 1153 - RNA, 21 nt, artificial
  Completely synthesized
ugcuuuguacuuugaugacug

SEQ ID NO: 1154 - RNA, 21 nt, artificial
  Completely synthesized
agaugcuuuguacuuugauga

SEQ ID NO: 1155 - RNA, 21 nt, artificial
  Completely synthesized
cagcaggacauggauuugauu

SEQ ID NO: 1156 - RNA, 21 nt, artificial
  Completely synthesized
uuacaacuagaugaagagaca

SEQ ID NO: 1157 - RNA, 21 nt, artificial
  Completely synthesized
agagcugguacuaauaaagga

SEQ ID NO: 1158 - RNA, 21 nt, artificial
  Completely synthesized
ugacaucuggcuaaaaagaaa

SEQ ID NO: 1159 - RNA, 21 nt, artificial
  Completely synthesized
cuaguuucuguguaaguguaa

SEQ ID NO: 1160 - RNA, 21 nt, artificial
  Completely synthesized
ggcuaguuucuguguaagugu

SEQ ID NO: 1161 - RNA, 21 nt, artificial
  Completely synthesized
ugggcuaguuucuguguaagu

SEQ ID NO: 1162 - RNA, 21 nt, artificial
  Completely synthesized
aaacaauuucuuaggacacca

SEQ ID NO: 1163 - RNA, 21 nt, artificial
  Completely synthesized
gagugucaguauguugaauca

SEQ ID NO: 1164 - RNA, 21 nt, artificial
  Completely synthesized
uacuaaaagcuccuacuguga

SEQ ID NO: 1165 - RNA, 21 nt, artificial
  Completely synthesized
ugcuacgugaugaagauggaa

SEQ ID NO: 1166 - RNA, 21 nt, artificial
  Completely synthesized
gcaccuuauaucucgaaguuu

SEQ ID NO: 1167 - RNA, 21 nt, artificial
  Completely synthesized
cagcaccuuauaucucgaagu

SEQ ID NO: 1168 - RNA, 21 nt, artificial
  Completely synthesized
caccuacugaaaaaacaacuc

SEQ ID NO: 1169 - RNA, 21 nt, artificial
  Completely synthesized
aacuagagcaagauuuagauc

SEQ ID NO: 1170 - RNA, 21 nt, artificial
  Completely synthesized
uaguagaacuagagcaagauu

SEQ ID NO: 1171 - RNA, 21 nt, artificial
  Completely synthesized
gggauauacguaggaggggua

SEQ ID NO: 1172 - RNA, 21 nt, artificial
  Completely synthesized
ugagaacacaccagagaaaga

SEQ ID NO: 1173 - RNA, 21 nt, artificial
  Completely synthesized
aaagaguaugagcuggaaaaa

SEQ ID NO: 1174 - RNA, 21 nt, artificial
  Completely synthesized
cggaaagaguaugagcuggaa

SEQ ID NO: 1175 - RNA, 21 nt, artificial
  Completely synthesized
ugccccuggaagugucaaaca

SEQ ID NO: 1176 - RNA, 21 nt, artificial
  Completely synthesized
auagugccccuggaaguguca

SEQ ID NO: 1177 - RNA, 21 nt, artificial
  Completely synthesized
agcgacggaaagaguaugagc

SEQ ID NO: 1178 - RNA, 21 nt, artificial
  Completely synthesized
cagcgacggaaagaguaugag

SEQ ID NO: 1179 - RNA, 21 nt, artificial
  Completely synthesized
gggcccauugauguuucugau

SEQ ID NO: 1180 - RNA, 21 nt, artificial
  Completely synthesized
cuguaguccacauuuucuuaa

SEQ ID NO: 1181 - RNA, 21 nt, artificial
  Completely synthesized
cucaauggaaaaagaaguagg

SEQ ID NO: 1182 - RNA, 21 nt, artificial
  Completely synthesized
gaucuuggaguaagucgagaa

SEQ ID NO: 1183 - RNA, 21 nt, artificial
  Completely synthesized
cuuuggaggcaagauauagau

SEQ ID NO: 1184 - RNA, 21 nt, artificial
  Completely synthesized
gacauugagcaaguuugggag

SEQ ID NO: 1185 - RNA, 21 nt, artificial
  Completely synthesized
ggacauugagcaaguuuggga

SEQ ID NO: 1186 - RNA, 21 nt, artificial
  Completely synthesized
gucaccugaaacuucuguugc

SEQ ID NO: 1187 - RNA, 21 nt, artificial
  Completely synthesized
gcccagucuucauugcuacua

SEQ ID NO: 1188 - RNA, 21 nt, artificial
  Completely synthesized
ucgagagcccagucuucauug

SEQ ID NO: 1189 - RNA, 21 nt, artificial
  Completely synthesized
ucggcuacguuucagucacuu

SEQ ID NO: 1190 - RNA, 21 nt, artificial
  Completely synthesized
gagguuucuucggcuacguuu

SEQ ID NO: 1191 - RNA, 21 nt, artificial
  Completely synthesized
uuguacuuugaugacugcaug

SEQ ID NO: 1192 - RNA, 21 nt, artificial
  Completely synthesized
augcuuuguacuuugaugacu

SEQ ID NO: 1193 - RNA, 21 nt, artificial
  Completely synthesized
gaugcuuuguacuuugaugac

SEQ ID NO: 1194 - RNA, 21 nt, artificial
  Completely synthesized
cuagaugaagagacaggugaa

SEQ ID NO: 1195 - RNA, 21 nt, artificial
  Completely synthesized
guauggacaaaaaauggcauu

SEQ ID NO: 1196 - RNA, 21 nt, artificial
  Completely synthesized
uguauggacaaaaaauggcau

SEQ ID NO: 1197 - RNA, 21 nt, artificial
  Completely synthesized
acaauuucuuaggacaccauu

SEQ ID NO: 1198 - RNA, 21 nt, artificial
  Completely synthesized
ugaugugaaaugcucauacuu

SEQ ID NO: 1199 - RNA, 21 nt, artificial
  Completely synthesized
uccuacugugaugugaaaugc

SEQ ID NO: 1200 - RNA, 21 nt, artificial
  Completely synthesized
uccuagugaauacucccugca

SEQ ID NO: 1201 - RNA, 21 nt, artificial
  Completely synthesized
acacgguccacagcucaucau

SEQ ID NO: 1202 - RNA, 21 nt, artificial
  Completely synthesized
gaagugucaaacagaaugguc

SEQ ID NO: 1203 - RNA, 21 nt, artificial
  Completely synthesized
uggaagugucaaacagaaugg

SEQ ID NO: 1204 - RNA, 21 nt, artificial
  Completely synthesized
gugauucugaaguggaagagc

SEQ ID NO: 1205 - RNA, 21 nt, artificial
  Completely synthesized
gaaagcacagcagaauucaau

SEQ ID NO: 1206 - RNA, 21 nt, artificial
  Completely synthesized
cacagucaacacagauuuugg

SEQ ID NO: 1207 - RNA, 21 nt, artificial
  Completely synthesized
cagaagccaaacugacagaag

SEQ ID NO: 1208 - RNA, 21 nt, artificial
  Completely synthesized
accugaaacuucuguugcuca

SEQ ID NO: 1209 - RNA, 21 nt, artificial
  Completely synthesized
uugacauacuuuggaggcaag

SEQ ID NO: 1210 - RNA, 21 nt, artificial
  Completely synthesized
uugauugacauacuuuggagg

SEQ ID NO: 1211 - RNA, 21 nt, artificial
  Completely synthesized
gucacuuguuccugauauucc

SEQ ID NO: 1212 - RNA, 21 nt, artificial
  Completely synthesized
gcuuuguacuuugaugacugc

SEQ ID NO: 1213 - RNA, 21 nt, artificial
  Completely synthesized
caggacauggauuugauugac

SEQ ID NO: 1214 - RNA, 21 nt, artificial
  Completely synthesized
caguuacaacuagaugaagag

SEQ ID NO: 1215 - RNA, 21 nt, artificial
  Completely synthesized
gauaugacaucuggcuaaaaa

SEQ ID NO: 1216 - RNA, 21 nt, artificial
  Completely synthesized
caguauguugaaucaguaguu

SEQ ID NO: 1217 - RNA, 21 nt, artificial
  Completely synthesized
agcauuggagugucaguaugu

SEQ ID NO: 1218 - RNA, 21 nt, artificial
  Completely synthesized
aaagcauuggagugucaguau

SEQ ID NO: 1219 - RNA, 21 nt, artificial
  Completely synthesized
ccuacugugaugugaaaugcu

SEQ ID NO: 1220 - RNA, 21 nt, artificial
  Completely synthesized
ugaccuuuucugagcuaguuu

SEQ ID NO: 1221 - RNA, 21 nt, artificial
  Completely synthesized
gauuugaccuuuucugagcua

SEQ ID NO: 1222 - RNA, 21 nt, artificial
  Completely synthesized
cagcaugcuacgugaugaaga

SEQ ID NO: 1223 - RNA, 21 nt, artificial
  Completely synthesized
caccuuauaucucgaaguuuu

SEQ ID NO: 1224 - RNA, 21 nt, artificial
  Completely synthesized
ucagcaccuuauaucucgaag

SEQ ID NO: 1225 - RNA, 21 nt, artificial
  Completely synthesized
acucagcaccuuauaucucga

SEQ ID NO: 1226 - RNA, 21 nt, artificial
  Completely synthesized
auaguagaacuagagcaagau

SEQ ID NO: 1227 - RNA, 21 nt, artificial
  Completely synthesized
ggauauacguaggagggguaa

SEQ ID NO: 1228 - RNA, 21 nt, artificial
  Completely synthesized
aaagcucuccauaucccauuc

SEQ ID NO: 1229 - RNA, 21 nt, artificial
  Completely synthesized
gcaaaagcucuccauauccca

SEQ ID NO: 1230 - RNA, 21 nt, artificial
  Completely synthesized
agagaugaacuuagggcaaaa

SEQ ID NO: 1231 - RNA, 21 nt, artificial
  Completely synthesized
caagagaugaacuuagggcaa

SEQ ID NO: 1232 - RNA, 21 nt, artificial
  Completely synthesized
ucacaagagaugaacuuaggg

SEQ ID NO: 1233 - RNA, 21 nt, artificial
  Completely synthesized
ggaagugucaaacagaauggu

SEQ ID NO: 1234 - RNA, 21 nt, artificial
  Completely synthesized
ccuggaagugucaaacagaau

SEQ ID NO: 1235 - RNA, 21 nt, artificial
  Completely synthesized
gauucugaaguggaagagcua

SEQ ID NO: 1236 - RNA, 21 nt, artificial
  Completely synthesized
gcgacggaaagaguaugagcu

SEQ ID NO: 1237 - RNA, 21 nt, artificial
  Completely synthesized
uucugaucuaucacuuugcaa

SEQ ID NO: 1238 - RNA, 21 nt, artificial
  Completely synthesized
aucuuggaguaagucgagaag

SEQ ID NO: 1239 - RNA, 21 nt, artificial
  Completely synthesized
caacaggacauugagcaaguu

SEQ ID NO: 1240 - RNA, 21 nt, artificial
  Completely synthesized
ucaccugaaacuucuguugcu

SEQ ID NO: 1241 - RNA, 21 nt, artificial
  Completely synthesized
aucgagagcccagucuucauu

SEQ ID NO: 1242 - RNA, 21 nt, artificial
  Completely synthesized
uacguuucagucacuuguucc

SEQ ID NO: 1243 - RNA, 21 nt, artificial
  Completely synthesized
gcuacguuucagucacuuguu

SEQ ID NO: 1244 - RNA, 21 nt, artificial
  Completely synthesized
ggcuacguuucagucacuugu

SEQ ID NO: 1245 - RNA, 21 nt, artificial
  Completely synthesized
cggcuacguuucagucacuug

SEQ ID NO: 1246 - RNA, 21 nt, artificial
  Completely synthesized
uuucuucggcuacguuucagu

SEQ ID NO: 1247 - RNA, 21 nt, artificial
  Completely synthesized
gacauggauuugauugacaua

SEQ ID NO: 1248 - RNA, 21 nt, artificial
  Completely synthesized
auaugacaucuggcuaaaaag

SEQ ID NO: 1249 - RNA, 21 nt, artificial
  Completely synthesized
uugggcuaguuucuguguaag

SEQ ID NO: 1250 - RNA, 21 nt, artificial
  Completely synthesized
gucaguauguugaaucaguag

SEQ ID NO: 1251 - RNA, 21 nt, artificial
  Completely synthesized
ugucaguauguugaaucagua

SEQ ID NO: 1252 - RNA, 21 nt, artificial
  Completely synthesized
gugucaguauguugaaucagu

SEQ ID NO: 1253 - RNA, 21 nt, artificial
  Completely synthesized
uuggagugucaguauguugaa

SEQ ID NO: 1254 - RNA, 21 nt, artificial
  Completely synthesized
uacugugaugugaaaugcuca

SEQ ID NO: 1255 - RNA, 21 nt, artificial
  Completely synthesized
accuuuucugagcuaguuuuu

SEQ ID NO: 1256 - RNA, 21 nt, artificial
  Completely synthesized
uuugaccuuuucugagcuagu

SEQ ID NO: 1257 - RNA, 21 nt, artificial
  Completely synthesized
ugcagcaaacaagagauggca

SEQ ID NO: 1258 - RNA, 21 nt, artificial
  Completely synthesized
cuccuagugaauacucccugc

SEQ ID NO: 1259 - RNA, 21 nt, artificial
  Completely synthesized
gcaugcuacgugaugaagaug

SEQ ID NO: 1260 - RNA, 21 nt, artificial
  Completely synthesized
accuuauaucucgaaguuuuc

SEQ ID NO: 1261 - RNA, 21 nt, artificial
  Completely synthesized
uuaauucgggauauacguagg

SEQ ID NO: 1262 - RNA, 21 nt, artificial
  Completely synthesized
caacgaaaugauguccaaaga

SEQ ID NO: 1263 - RNA, 21 nt, artificial
  Completely synthesized
aaccucccuguuguugacuuc

SEQ ID NO: 1264 - RNA, 21 nt, artificial
  Completely synthesized
gagaugaacuuagggcaaaag

SEQ ID NO: 1265 - RNA, 21 nt, artificial
  Completely synthesized
acaagagaugaacuuagggca

SEQ ID NO: 1266 - RNA, 21 nt, artificial
  Completely synthesized
aaagcacagcagaauucaaug

SEQ ID NO: 1267 - RNA, 21 nt, artificial
  Completely synthesized
gauguuucugaucuaucacuu

SEQ ID NO: 1268 - RNA, 21 nt, artificial
  Completely synthesized
acagucaacacagauuuuggu

SEQ ID NO: 1269 - RNA, 21 nt, artificial
  Completely synthesized
ugaggauuccuucagcagcau

SEQ ID NO: 1270 - RNA, 21 nt, artificial
  Completely synthesized
ugacauacuuuggaggcaaga

SEQ ID NO: 1271 - RNA, 21 nt, artificial
  Completely synthesized
cauggauuugauugacauacu

SEQ ID NO: 1272 - RNA, 21 nt, artificial
  Completely synthesized
gcaggacauggauuugauuga

SEQ ID NO: 1273 - RNA, 21 nt, artificial
  Completely synthesized
augaagagacaggugaauuuc

SEQ ID NO: 1274 - RNA, 21 nt, artificial
  Completely synthesized
agaugaagagacaggugaauu

SEQ ID NO: 1275 - RNA, 21 nt, artificial
  Completely synthesized
uugcaaaacuaaccacuaugu

SEQ ID NO: 1276 - RNA, 21 nt, artificial
  Completely synthesized
augacaucuggcuaaaaagaa

SEQ ID NO: 1277 - RNA, 21 nt, artificial
  Completely synthesized
gggcuaguuucuguguaagug

SEQ ID NO: 1278 - RNA, 21 nt, artificial
  Completely synthesized
uuugggcuaguuucuguguaa

SEQ ID NO: 1279 - RNA, 21 nt, artificial
  Completely synthesized
ggagugucaguauguugaauc

SEQ ID NO: 1280 - RNA, 21 nt, artificial
  Completely synthesized
ugugaugugaaaugcucauac

SEQ ID NO: 1281 - RNA, 21 nt, artificial
  Completely synthesized
cucagcaccuuauaucucgaa

SEQ ID NO: 1282 - RNA, 21 nt, artificial
  Completely synthesized
uaauucgggauauacguagga

SEQ ID NO: 1283 - RNA, 21 nt, artificial
  Completely synthesized
aaagacaagaacaacuccaaa

SEQ ID NO: 1284 - RNA, 21 nt, artificial
  Completely synthesized
gaaagacaagaacaacuccaa

SEQ ID NO: 1285 - RNA, 21 nt, artificial
  Completely synthesized
cgaaaugauguccaaagagca

SEQ ID NO: 1286 - RNA, 21 nt, artificial
  Completely synthesized
aacgaaaugauguccaaagag

SEQ ID NO: 1287 - RNA, 21 nt, artificial
  Completely synthesized
accucccuguuguugacuuca

SEQ ID NO: 1288 - RNA, 21 nt, artificial
  Completely synthesized
aucauuaaccucccuguuguu

SEQ ID NO: 1289 - RNA, 21 nt, artificial
  Completely synthesized
uuucugaucuaucacuuugca

SEQ ID NO: 1290 - RNA, 21 nt, artificial
  Completely synthesized
cacuuguuccugauauucccg

SEQ ID NO: 1291 - RNA, 21 nt, artificial
  Completely synthesized
gauuugauugacauacuuugg

SEQ ID NO: 1292 - RNA, 21 nt, artificial
  Completely synthesized
acguuucagucacuuguuccu

SEQ ID NO: 1293 - RNA, 21 nt, artificial
  Completely synthesized
acaggugaauuucucccaauu

SEQ ID NO: 1294 - RNA, 21 nt, artificial
  Completely synthesized
gagcugguacuaauaaaggau

SEQ ID NO: 1295 - RNA, 21 nt, artificial
  Completely synthesized
cugugaugugaaaugcucaua

SEQ ID NO: 1296 - RNA, 21 nt, artificial
  Completely synthesized
gaaaaacuagauuuaggagga

SEQ ID NO: 1297 - RNA, 21 nt, artificial
  Completely synthesized
gcucaaagaaaaaggagaaaa

SEQ ID NO: 1298 - RNA, 21 nt, artificial
  Completely synthesized
agacaagaacaacuccaaaag

SEQ ID NO: 1299 - RNA, 21 nt, artificial
  Completely synthesized
uucgggauauacguaggaggg

SEQ ID NO: 1300 - RNA, 21 nt, artificial
  Completely synthesized
auguccaaagagcaguucaau

SEQ ID NO: 1301 - RNA, 21 nt, artificial
  Completely synthesized
ugauguccaaagagcaguuca

SEQ ID NO: 1302 - RNA, 21 nt, artificial
  Completely synthesized
gagcuggaaaaacagaaaaaa

SEQ ID NO: 1303 - RNA, 21 nt, artificial
  Completely synthesized
ccggcauuucacuaaacacaa

SEQ ID NO: 1304 - RNA, 21 nt, artificial
  Completely synthesized
uugauguuucugaucuaucac

SEQ ID NO: 1305 - RNA, 21 nt, artificial
  Completely synthesized
ccauugauguuucugaucuau

SEQ ID NO: 1306 - RNA, 21 nt, artificial
  Completely synthesized
cccauugauguuucugaucua

SEQ ID NO: 1307 - RNA, 21 nt, artificial
  Completely synthesized
ggcccauugauguuucugauc

SEQ ID NO: 1308 - RNA, 21 nt, artificial
  Completely synthesized
aagaaguagguaacuguaguc

SEQ ID NO: 1309 - RNA, 21 nt, artificial
  Completely synthesized
gaccuuuucugagcuaguuuu

SEQ ID NO: 1310 - RNA, 21 nt, artificial
  Completely synthesized
aucucgaaguuuucagcaugc

SEQ ID NO: 1311 - RNA, 21 nt, artificial
  Completely synthesized
aagacaagaacaacuccaaaa

SEQ ID NO: 1312 - RNA, 21 nt, artificial
  Completely synthesized
gaaaaccccauucacaaaaga

SEQ ID NO: 1313 - RNA, 21 nt, artificial
  Completely synthesized
gauaugguacaacccuuguca

SEQ ID NO: 1314 - RNA, 21 nt, artificial
  Completely synthesized
gaaguggaagagcuagauagu

SEQ ID NO: 1315 - RNA, 21 nt, artificial
  Completely synthesized
guuucugaucuaucacuuugc

SEQ ID NO: 1316 - RNA, 21 nt, artificial
  Completely synthesized
gcccauugauguuucugaucu

SEQ ID NO: 1317 - RNA, 21 nt, artificial
  Completely synthesized
uugcccacauucccaaaucag

SEQ ID NO: 1318 - RNA, 21 nt, artificial
  Completely synthesized
guugcccacauucccaaauca

SEQ ID NO: 1319 - RNA, 21 nt, artificial
  Completely synthesized
gcagcaaacaagagauggcaa

SEQ ID NO: 1320 - RNA, 21 nt, artificial
  Completely synthesized
ugcucaaagaaaaaggagaaa

SEQ ID NO: 1321 - RNA, 21 nt, artificial
  Completely synthesized
gaagcucaacuugcauuaauu

SEQ ID NO: 1322 - RNA, 21 nt, artificial
  Completely synthesized
caaagagcaguucaaugaagc

SEQ ID NO: 1323 - RNA, 21 nt, artificial
  Completely synthesized
ggaaaaccccauucacaaaag

SEQ ID NO: 1324 - RNA, 21 nt, artificial
  Completely synthesized
ugagcuggaaaaacagaaaaa

SEQ ID NO: 1325 - RNA, 21 nt, artificial
  Completely synthesized
gcccaguaucagcaacagcau

SEQ ID NO: 1326 - RNA, 21 nt, artificial
  Completely synthesized
uagguaacuguaguccacauu

SEQ ID NO: 1327 - RNA, 21 nt, artificial
  Completely synthesized
cauuccugaguuacagugucu

SEQ ID NO: 1328 - RNA, 21 nt, artificial
  Completely synthesized
ccguuuguagaugacaaugag

SEQ ID NO: 1329 - RNA, 21 nt, artificial
  Completely synthesized
gcugguacuaauaaaggauua

SEQ ID NO: 1330 - RNA, 21 nt, artificial
  Completely synthesized
aggacaccauuugggcuaguu

SEQ ID NO: 1331 - RNA, 21 nt, artificial
  Completely synthesized
gcucuccauaucccauucccu

SEQ ID NO: 1332 - RNA, 21 nt, artificial
  Completely synthesized
ugggcccauugauguuucuga

SEQ ID NO: 1333 - RNA, 21 nt, artificial
  Completely synthesized
acuuuaagccauucacucucu

SEQ ID NO: 1334 - RNA, 21 nt, artificial
  Completely synthesized
caccugcuacuuuaagccauu

SEQ ID NO: 1335 - RNA, 21 nt, artificial
  Completely synthesized
cucaccugcuacuuuaagcca

SEQ ID NO: 1336 - RNA, 21 nt, artificial
  Completely synthesized
ugaaaaugacaagcugguuga

SEQ ID NO: 1337 - RNA, 21 nt, artificial
  Completely synthesized
agcugguacuaauaaaggauu

SEQ ID NO: 1338 - RNA, 21 nt, artificial
  Completely synthesized
augcaaaaucauagccaaaac

SEQ ID NO: 1339 - RNA, 21 nt, artificial
  Completely synthesized
caaacaagagauggcaauguu

SEQ ID NO: 1340 - RNA, 21 nt, artificial
  Completely synthesized
gaaaaugacaaaagccuucac

SEQ ID NO: 1341 - RNA, 21 nt, artificial
  Completely synthesized
aaaaccccauucacaaaagac

SEQ ID NO: 1342 - RNA, 21 nt, artificial
  Completely synthesized
augagcuggaaaaacagaaaa

SEQ ID NO: 1343 - RNA, 21 nt, artificial
  Completely synthesized
cugaaguggaagagcuagaua

SEQ ID NO: 1344 - RNA, 21 nt, artificial
  Completely synthesized
acuccggcauuucacuaaaca

SEQ ID NO: 1345 - RNA, 21 nt, artificial
  Completely synthesized
ccauucacucucugaacuucu

SEQ ID NO: 1346 - RNA, 21 nt, artificial
  Completely synthesized
agccauucacucucugaacuu

SEQ ID NO: 1347 - RNA, 21 nt, artificial
  Completely synthesized
cugcuacuuuaagccauucac

SEQ ID NO: 1348 - RNA, 21 nt, artificial
  Completely synthesized
ucaccugcuacuuuaagccau

SEQ ID NO: 1349 - RNA, 21 nt, artificial
  Completely synthesized
ugcccucaccugcuacuuuaa

SEQ ID NO: 1350 - RNA, 21 nt, artificial
  Completely synthesized
augcccucaccugcuacuuua

SEQ ID NO: 1351 - RNA, 21 nt, artificial
  Completely synthesized
auggaaaaagaaguagguaac

SEQ ID NO: 1352 - RNA, 21 nt, artificial
  Completely synthesized
gaagccaaacugacagaaguu

SEQ ID NO: 1353 - RNA, 21 nt, artificial
  Completely synthesized
uuaaaaagcauuggaguguca

SEQ ID NO: 1354 - RNA, 21 nt, artificial
  Completely synthesized
ggcaauguuuuccuuguuccc

SEQ ID NO: 1355 - RNA, 21 nt, artificial
  Completely synthesized
acaacucagcaccuuauaucu

SEQ ID NO: 1356 - RNA, 21 nt, artificial
  Completely synthesized
ggcugcucagaauugcagaaa

SEQ ID NO: 1357 - RNA, 21 nt, artificial
  Completely synthesized
agcucuccauaucccauuccc

SEQ ID NO: 1358 - RNA, 21 nt, artificial
  Completely synthesized
aagcucuccauaucccauucc

SEQ ID NO: 1359 - RNA, 21 nt, artificial
  Completely synthesized
aagacaaacauucaagccgcu

SEQ ID NO: 1360 - RNA, 21 nt, artificial
  Completely synthesized
aaaccccauucacaaaagaca

SEQ ID NO: 1361 - RNA, 21 nt, artificial
  Completely synthesized
cggcauuucacuaaacacaag

SEQ ID NO: 1362 - RNA, 21 nt, artificial
  Completely synthesized
cccguuuguagaugacaauga

SEQ ID NO: 1363 - RNA, 21 nt, artificial
  Completely synthesized
ucccguuuguagaugacaaug

SEQ ID NO: 1364 - RNA, 21 nt, artificial
  Completely synthesized
aucugccaacuacucccaggu

SEQ ID NO: 1365 - RNA, 21 nt, artificial
  Completely synthesized
gccagauguuaagaaaaacua

SEQ ID NO: 1366 - RNA, 21 nt, artificial
  Completely synthesized
aaaugacaaaagccuucaccu

SEQ ID NO: 1367 - RNA, 21 nt, artificial
  Completely synthesized
cugcucagaauugcagaaaaa

SEQ ID NO: 1368 - RNA, 21 nt, artificial
  Completely synthesized
aagcucaacuugcauuaauuc

SEQ ID NO: 1369 - RNA, 21 nt, artificial
  Completely synthesized
gucaucggaaaaccccauuca

SEQ ID NO: 1370 - RNA, 21 nt, artificial
  Completely synthesized
ccccaaccaguugacagugaa

SEQ ID NO: 1371 - RNA, 21 nt, artificial
  Completely synthesized
gaaaaagaaguagguaacugu

SEQ ID NO: 1372 - RNA, 21 nt, artificial
  Completely synthesized
uggaaaaagaaguagguaacu

SEQ ID NO: 1373 - RNA, 21 nt, artificial
  Completely synthesized
caaguccagaagccaaacuga

SEQ ID NO: 1374 - RNA, 21 nt, artificial
  Completely synthesized
ugggaggagcuauuauccauu

SEQ ID NO: 1375 - RNA, 21 nt, artificial
  Completely synthesized
ugcaaaacuaaccacuaugua

SEQ ID NO: 1376 - RNA, 21 nt, artificial
  Completely synthesized
auggaaaaccuuauucuccua

SEQ ID NO: 1377 - RNA, 21 nt, artificial
  Completely synthesized
agccuucaccuacugaaaaaa

SEQ ID NO: 1378 - RNA, 21 nt, artificial
  Completely synthesized
aaggagaaaaugacaaaagcc

SEQ ID NO: 1379 - RNA, 21 nt, artificial
  Completely synthesized
aaagacaaacauucaagccgc

SEQ ID NO: 1380 - RNA, 21 nt, artificial
  Completely synthesized
uaaguccuggucaucggaaaa

SEQ ID NO: 1381 - RNA, 21 nt, artificial
  Completely synthesized
uaugagcuggaaaaacagaaa

SEQ ID NO: 1382 - RNA, 21 nt, artificial
  Completely synthesized
acaacccuugucaccaucuca

SEQ ID NO: 1383 - RNA, 21 nt, artificial
  Completely synthesized
guacaacccuugucaccaucu

SEQ ID NO: 1384 - RNA, 21 nt, artificial
  Completely synthesized
gacacacuacuuggccucagu

SEQ ID NO: 1385 - RNA, 21 nt, artificial
  Completely synthesized
cugaucuaucacuuugcaaag

SEQ ID NO: 1386 - RNA, 21 nt, artificial
  Completely synthesized
ccugcuacuuuaagccauuca

SEQ ID NO: 1387 - RNA, 21 nt, artificial
  Completely synthesized
cgagaaguauuugacuucagu

SEQ ID NO: 1388 - RNA, 21 nt, artificial
  Completely synthesized
uucccguuuguagaugacaau

SEQ ID NO: 1389 - RNA, 21 nt, artificial
  Completely synthesized
gcgcagacauucccguuugua

SEQ ID NO: 1390 - RNA, 21 nt, artificial
  Completely synthesized
uggaucugccaacuacuccca

SEQ ID NO: 1391 - RNA, 21 nt, artificial
  Completely synthesized
gcucaguuacaacuagaugaa

SEQ ID NO: 1392 - RNA, 21 nt, artificial
  Completely synthesized
gcaaaaucauagccaaaacua

SEQ ID NO: 1393 - RNA, 21 nt, artificial
  Completely synthesized
cugagcuaguuuuuuuguacu

SEQ ID NO: 1394 - RNA, 21 nt, artificial
  Completely synthesized
ggaggauuugaccuuuucuga

SEQ ID NO: 1395 - RNA, 21 nt, artificial
  Completely synthesized
uaggaggauuugaccuuuucu

SEQ ID NO: 1396 - RNA, 21 nt, artificial
  Completely synthesized
gcugcucagaauugcagaaaa

SEQ ID NO: 1397 - RNA, 21 nt, artificial
  Completely synthesized
guggcugcucagaauugcaga

SEQ ID NO: 1398 - RNA, 21 nt, artificial
  Completely synthesized
aaguggcugcucagaauugca

SEQ ID NO: 1399 - RNA, 21 nt, artificial
  Completely synthesized
ugguccuaaaacaccaguaca

SEQ ID NO: 1400 - RNA, 21 nt, artificial
  Completely synthesized
gaaugguccuaaaacaccagu

SEQ ID NO: 1401 - RNA, 21 nt, artificial
  Completely synthesized
ggccucagugauucugaagug

SEQ ID NO: 1402 - RNA, 21 nt, artificial
  Completely synthesized
ucuuccagcuauggagacaca

SEQ ID NO: 1403 - RNA, 21 nt, artificial
  Completely synthesized
ggcauuucacuaaacacaagu

SEQ ID NO: 1404 - RNA, 21 nt, artificial
  Completely synthesized
gacuccggcauuucacuaaac

SEQ ID NO: 1405 - RNA, 21 nt, artificial
  Completely synthesized
ugcuacuuuaagccauucacu

SEQ ID NO: 1406 - RNA, 21 nt, artificial
  Completely synthesized
guauuugacuucagucagcga

SEQ ID NO: 1407 - RNA, 21 nt, artificial
  Completely synthesized
ugagcccaguaucagcaacag

SEQ ID NO: 1408 - RNA, 21 nt, artificial
  Completely synthesized
gagaaguauuugacuucaguc

SEQ ID NO: 1409 - RNA, 21 nt, artificial
  Completely synthesized
ucgagaaguauuugacuucag

SEQ ID NO: 1410 - RNA, 21 nt, artificial
  Completely synthesized
cagugaacucauuaaauucag

SEQ ID NO: 1411 - RNA, 21 nt, artificial
  Completely synthesized
agaagccaaacugacagaagu

SEQ ID NO: 1412 - RNA, 21 nt, artificial
  Completely synthesized
gggaggagcuauuauccauuc

SEQ ID NO: 1413 - RNA, 21 nt, artificial
  Completely synthesized
uugggaggagcuauuauccau

SEQ ID NO: 1414 - RNA, 21 nt, artificial
  Completely synthesized
gccccuguugauuuagacggu

SEQ ID NO: 1415 - RNA, 21 nt, artificial
  Completely synthesized
gacaggugaauuucucccaau

SEQ ID NO: 1416 - RNA, 21 nt, artificial
  Completely synthesized
ugcaaaaucauagccaaaacu

SEQ ID NO: 1417 - RNA, 21 nt, artificial
  Completely synthesized
ucccaaaaguaagaagccaga

SEQ ID NO: 1418 - RNA, 21 nt, artificial
  Completely synthesized
uuguucccaaaaguaagaagc

SEQ ID NO: 1419 - RNA, 21 nt, artificial
  Completely synthesized
acaacuccaaaaggagcaaga

SEQ ID NO: 1420 - RNA, 21 nt, artificial
  Completely synthesized
ucccauucccuguagaaaaaa

SEQ ID NO: 1421 - RNA, 21 nt, artificial
  Completely synthesized
ucaucggaaaaccccauucac

SEQ ID NO: 1422 - RNA, 21 nt, artificial
  Completely synthesized
cagagaaagaauugccuguaa

SEQ ID NO: 1423 - RNA, 21 nt, artificial
  Completely synthesized
cagagcacucacgugcaugau

SEQ ID NO: 1424 - RNA, 21 nt, artificial
  Completely synthesized
caccaguacauucuucugggg

SEQ ID NO: 1425 - RNA, 21 nt, artificial
  Completely synthesized
uccggcauuucacuaaacaca

SEQ ID NO: 1426 - RNA, 21 nt, artificial
  Completely synthesized
ugacuccggcauuucacuaaa

SEQ ID NO: 1427 - RNA, 21 nt, artificial
  Completely synthesized
cccucaccugcuacuuuaagc

SEQ ID NO: 1428 - RNA, 21 nt, artificial
  Completely synthesized
guccagaagccaaacugacag

SEQ ID NO: 1429 - RNA, 21 nt, artificial
  Completely synthesized
gcugguugagacuaccauggu

SEQ ID NO: 1430 - RNA, 21 nt, artificial
  Completely synthesized
uuccugaguuacagugucuua

SEQ ID NO: 1431 - RNA, 21 nt, artificial
  Completely synthesized
ccccuguugauuuagacggua

SEQ ID NO: 1432 - RNA, 21 nt, artificial
  Completely synthesized
ccaguggaucugccaacuacu

SEQ ID NO: 1433 - RNA, 21 nt, artificial
  Completely synthesized
agacaggugaauuucucccaa

SEQ ID NO: 1434 - RNA, 21 nt, artificial
  Completely synthesized
ucgcucaguuacaacuagaug

SEQ ID NO: 1435 - RNA, 21 nt, artificial
  Completely synthesized
ccagauguuaagaaaaacuag

SEQ ID NO: 1436 - RNA, 21 nt, artificial
  Completely synthesized
agccagauguuaagaaaaacu

SEQ ID NO: 1437 - RNA, 21 nt, artificial
  Completely synthesized
auggcaauguuuuccuuguuc

SEQ ID NO: 1438 - RNA, 21 nt, artificial
  Completely synthesized
agagauggcaauguuuuccuu

SEQ ID NO: 1439 - RNA, 21 nt, artificial
  Completely synthesized
gaacaacuccaaaaggagcaa

SEQ ID NO: 1440 - RNA, 21 nt, artificial
  Completely synthesized
gggcaaaagcucuccauaucc

SEQ ID NO: 1441 - RNA, 21 nt, artificial
  Completely synthesized
aucggaaaaccccauucacaa

SEQ ID NO: 1442 - RNA, 21 nt, artificial
  Completely synthesized
acgugcaugaugcccaaugug

SEQ ID NO: 1443 - RNA, 21 nt, artificial
  Completely synthesized
gguccuaaaacaccaguacau

SEQ ID NO: 1444 - RNA, 21 nt, artificial
  Completely synthesized
cagucagcgacggaaagagua

SEQ ID NO: 1445 - RNA, 21 nt, artificial
  Completely synthesized
cuccggcauuucacuaaacac

SEQ ID NO: 1446 - RNA, 21 nt, artificial
  Completely synthesized
gacuucagucagcgacggaaa

SEQ ID NO: 1447 - RNA, 21 nt, artificial
  Completely synthesized
aagccauucacucucugaacu

SEQ ID NO: 1448 - RNA, 21 nt, artificial
  Completely synthesized
cugagcccaguaucagcaaca

SEQ ID NO: 1449 - RNA, 21 nt, artificial
  Completely synthesized
gacagugaacucauuaaauuc

SEQ ID NO: 1450 - RNA, 21 nt, artificial
  Completely synthesized
gaagaccccaaccaguugaca

SEQ ID NO: 1451 - RNA, 21 nt, artificial
  Completely synthesized
agccaaacugacagaaguuga

SEQ ID NO: 1452 - RNA, 21 nt, artificial
  Completely synthesized
aagcugguugagacuaccaug

SEQ ID NO: 1453 - RNA, 21 nt, artificial
  Completely synthesized
gaggagcuauuauccauuccu

SEQ ID NO: 1454 - RNA, 21 nt, artificial
  Completely synthesized
gguccacagcucaucaugaug

SEQ ID NO: 1455 - RNA, 21 nt, artificial
  Completely synthesized
gcuacuaaucaggcucaguca

SEQ ID NO: 1456 - RNA, 21 nt, artificial
  Completely synthesized
cccagucuucauugcuacuaa

SEQ ID NO: 1457 - RNA, 21 nt, artificial
  Completely synthesized
ugaugacugcaugcagcuuuu

SEQ ID NO: 1458 - RNA, 21 nt, artificial
  Completely synthesized
gagacaggugaauuucuccca

SEQ ID NO: 1459 - RNA, 21 nt, artificial
  Completely synthesized
uuucgcucaguuacaacuaga

SEQ ID NO: 1460 - RNA, 21 nt, artificial
  Completely synthesized
augauaugacaucuggcuaaa

SEQ ID NO: 1461 - RNA, 21 nt, artificial
  Completely synthesized
ggacaccauuugggcuaguuu

SEQ ID NO: 1462 - RNA, 21 nt, artificial
  Completely synthesized
ucauagccaaaacuaguauag

SEQ ID NO: 1463 - RNA, 21 nt, artificial
  Completely synthesized
ucugagcuaguuuuuuuguac

SEQ ID NO: 1464 - RNA, 21 nt, artificial
  Completely synthesized
gagauggcaauguuuuccuug

SEQ ID NO: 1465 - RNA, 21 nt, artificial
  Completely synthesized
gugaauacucccugcagcaaa

SEQ ID NO: 1466 - RNA, 21 nt, artificial
  Completely synthesized
aaccuuauucuccuagugaau

SEQ ID NO: 1467 - RNA, 21 nt, artificial
  Completely synthesized
ggaaaaccuuauucuccuagu

SEQ ID NO: 1468 - RNA, 21 nt, artificial
  Completely synthesized
gccuucaccuacugaaaaaac

SEQ ID NO: 1469 - RNA, 21 nt, artificial
  Completely synthesized
ugcucagaauugcagaaaaag

SEQ ID NO: 1470 - RNA, 21 nt, artificial
  Completely synthesized
gaguaugagcuggaaaaacag

SEQ ID NO: 1471 - RNA, 21 nt, artificial
  Completely synthesized
augguccuaaaacaccaguac

SEQ ID NO: 1472 - RNA, 21 nt, artificial
  Completely synthesized
acacacuacuuggccucagug

SEQ ID NO: 1473 - RNA, 21 nt, artificial
  Completely synthesized
gagacacacuacuuggccuca

SEQ ID NO: 1474 - RNA, 21 nt, artificial
  Completely synthesized
auggagacacacuacuuggcc

SEQ ID NO: 1475 - RNA, 21 nt, artificial
  Completely synthesized
agcuauggagacacacuacuu

SEQ ID NO: 1476 - RNA, 21 nt, artificial
  Completely synthesized
gcauuucacuaaacacaaguc

SEQ ID NO: 1477 - RNA, 21 nt, artificial
  Completely synthesized
ucagucagcgacggaaagagu

SEQ ID NO: 1478 - RNA, 21 nt, artificial
  Completely synthesized
auucacucucugaacuucuaa

SEQ ID NO: 1479 - RNA, 21 nt, artificial
  Completely synthesized
aacacagauuuuggugaugaa

SEQ ID NO: 1480 - RNA, 21 nt, artificial
  Completely synthesized
gucaacacagauuuuggugau

SEQ ID NO: 1481 - RNA, 21 nt, artificial
  Completely synthesized
gaacucauuaaauucagaugc

SEQ ID NO: 1482 - RNA, 21 nt, artificial
  Completely synthesized
accaguugacagugaacucau

SEQ ID NO: 1483 - RNA, 21 nt, artificial
  Completely synthesized
agguaacuguaguccacauuu

SEQ ID NO: 1484 - RNA, 21 nt, artificial
  Completely synthesized
uauacccucaauggaaaaaga

SEQ ID NO: 1485 - RNA, 21 nt, artificial
  Completely synthesized
uccauuccugaguuacagugu

SEQ ID NO: 1486 - RNA, 21 nt, artificial
  Completely synthesized
ggagcuauuauccauuccuga

SEQ ID NO: 1487 - RNA, 21 nt, artificial
  Completely synthesized
acgguaugcaacaggacauug

SEQ ID NO: 1488 - RNA, 21 nt, artificial
  Completely synthesized
cccuguugauuuagacgguau

SEQ ID NO: 1489 - RNA, 21 nt, artificial
  Completely synthesized
guagccccuguugauuuagac

SEQ ID NO: 1490 - RNA, 21 nt, artificial
  Completely synthesized
gaaacuucuguugcucaggua

SEQ ID NO: 1491 - RNA, 21 nt, artificial
  Completely synthesized
gagagcccagucuucauugcu

SEQ ID NO: 1492 - RNA, 21 nt, artificial
  Completely synthesized
aaaccaguggaucugccaacu

SEQ ID NO: 1493 - RNA, 21 nt, artificial
  Completely synthesized
uuaggaggauuugaccuuuuc

SEQ ID NO: 1494 - RNA, 21 nt, artificial
  Completely synthesized
aagccagauguuaagaaaaac

SEQ ID NO: 1495 - RNA, 21 nt, artificial
  Completely synthesized
uucccaaaaguaagaagccag

SEQ ID NO: 1496 - RNA, 21 nt, artificial
  Completely synthesized
ggagcaagagaaagccuuuuu

SEQ ID NO: 1497 - RNA, 21 nt, artificial
  Completely synthesized
gauggcaauguuuuccuuguu

SEQ ID NO: 1498 - RNA, 21 nt, artificial
  Completely synthesized
aaggagcaagagaaagccuuu

SEQ ID NO: 1499 - RNA, 21 nt, artificial
  Completely synthesized
aagccuucaccuacugaaaaa

SEQ ID NO: 1500 - RNA, 21 nt, artificial
  Completely synthesized
ugaagcucaacuugcauuaau

SEQ ID NO: 1501 - RNA, 21 nt, artificial
  Completely synthesized
augaagcucaacuugcauuaa

SEQ ID NO: 1502 - RNA, 21 nt, artificial
  Completely synthesized
cccauucccuguagaaaaaau

SEQ ID NO: 1503 - RNA, 21 nt, artificial
  Completely synthesized
uuggaggcucaucucacaaga

SEQ ID NO: 1504 - RNA, 21 nt, artificial
  Completely synthesized
agcuggaaaaacagaaaaaac

SEQ ID NO: 1505 - RNA, 21 nt, artificial
  Completely synthesized
gugcaugaugcccaaugugag

SEQ ID NO: 1506 - RNA, 21 nt, artificial
  Completely synthesized
cacgugcaugaugcccaaugu

SEQ ID NO: 1507 - RNA, 21 nt, artificial
  Completely synthesized
acaccaguacauucuucuggg

SEQ ID NO: 1508 - RNA, 21 nt, artificial
  Completely synthesized
guccuaaaacaccaguacauu

SEQ ID NO: 1509 - RNA, 21 nt, artificial
  Completely synthesized
uggagacacacuacuuggccu

SEQ ID NO: 1510 - RNA, 21 nt, artificial
  Completely synthesized
acuuuauucuuaccccuccua

SEQ ID NO: 1511 - RNA, 21 nt, artificial
  Completely synthesized
agccacuuuauucuuaccccu

SEQ ID NO: 1512 - RNA, 21 nt, artificial
  Completely synthesized
uuucuuaacaucuggcuucuu

SEQ ID NO: 1513 - RNA, 21 nt, artificial
  Completely synthesized
gcuuuugucauuuucuccuuu

SEQ ID NO: 1514 - RNA, 21 nt, artificial
  Completely synthesized
gccacuuuauucuuaccccuc

SEQ ID NO: 1515 - RNA, 21 nt, artificial
  Completely synthesized
cuuuauucuuaccccuccuac

SEQ ID NO: 1516 - RNA, 21 nt, artificial
  Completely synthesized
aauucugagcagccacuuuau

SEQ ID NO: 1517 - RNA, 21 nt, artificial
  Completely synthesized
cacuuuauucuuaccccuccu

SEQ ID NO: 1518 - RNA, 21 nt, artificial
  Completely synthesized
acuuacaggcaauucuuucuc

SEQ ID NO: 1519 - RNA, 21 nt, artificial
  Completely synthesized
auuuagaaguucagagaguga

SEQ ID NO: 1520 - RNA, 21 nt, artificial
  Completely synthesized
ucaucuacaaacgggaauguc

SEQ ID NO: 1521 - RNA, 21 nt, artificial
  Completely synthesized
uuuucuuaacaucuggcuucu

SEQ ID NO: 1522 - RNA, 21 nt, artificial
  Completely synthesized
uucuuuuucugcaauucugag

SEQ ID NO: 1523 - RNA, 21 nt, artificial
  Completely synthesized
cugagcagccacuuuauucuu

SEQ ID NO: 1524 - RNA, 21 nt, artificial
  Completely synthesized
gcagccacuuuauucuuaccc

SEQ ID NO: 1525 - RNA, 21 nt, artificial
  Completely synthesized
uguucuugucuuuccuuuuca

SEQ ID NO: 1526 - RNA, 21 nt, artificial
  Completely synthesized
cuuaaaguagcaggugagggc

SEQ ID NO: 1527 - RNA, 21 nt, artificial
  Completely synthesized
agaaaccucauugucaucuac

SEQ ID NO: 1528 - RNA, 21 nt, artificial
  Completely synthesized
ucuuaacaucuggcuucuuac

SEQ ID NO: 1529 - RNA, 21 nt, artificial
  Completely synthesized
uuaacaucuggcuucuuacuu

SEQ ID NO: 1530 - RNA, 21 nt, artificial
  Completely synthesized
cagccacuuuauucuuacccc

SEQ ID NO: 1531 - RNA, 21 nt, artificial
  Completely synthesized
cuuacaggcaauucuuucucu

SEQ ID NO: 1532 - RNA, 21 nt, artificial
  Completely synthesized
cccauuuagaaguucagagag

SEQ ID NO: 1533 - RNA, 21 nt, artificial
  Completely synthesized
auugaggguauagaugaguaa

SEQ ID NO: 1534 - RNA, 21 nt, artificial
  Completely synthesized
auuaguagcaaugaagacugg

SEQ ID NO: 1535 - RNA, 21 nt, artificial
  Completely synthesized
aagaaaccucauugucaucua

SEQ ID NO: 1536 - RNA, 21 nt, artificial
  Completely synthesized
gucaucuacaaacgggaaugu

SEQ ID NO: 1537 - RNA, 21 nt, artificial
  Completely synthesized
guacauagugguuaguuuugc

SEQ ID NO: 1538 - RNA, 21 nt, artificial
  Completely synthesized
aacaucuggcuucuuacuuuu

SEQ ID NO: 1539 - RNA, 21 nt, artificial
  Completely synthesized
aucuggcuucuuacuuuuggg

SEQ ID NO: 1540 - RNA, 21 nt, artificial
  Completely synthesized
uucuccuuuuucuuugagcaa

SEQ ID NO: 1541 - RNA, 21 nt, artificial
  Completely synthesized
aucuaaaucuugcucuaguuc

SEQ ID NO: 1542 - RNA, 21 nt, artificial
  Completely synthesized
ucuuuuucugcaauucugagc

SEQ ID NO: 1543 - RNA, 21 nt, artificial
  Completely synthesized
guucuugucuuuccuuuucaa

SEQ ID NO: 1544 - RNA, 21 nt, artificial
  Completely synthesized
auucuuucucugguguguucu

SEQ ID NO: 1545 - RNA, 21 nt, artificial
  Completely synthesized
agaagaauguacugguguuuu

SEQ ID NO: 1546 - RNA, 21 nt, artificial
  Completely synthesized
uuuaggaccauucuguuugac

SEQ ID NO: 1547 - RNA, 21 nt, artificial
  Completely synthesized
gcuuucagggugguuuugguu

SEQ ID NO: 1548 - RNA, 21 nt, artificial
  Completely synthesized
uucagggugguuuugguugaa

SEQ ID NO: 1549 - RNA, 21 nt, artificial
  Completely synthesized
cauuuagaaguucagagagug

SEQ ID NO: 1550 - RNA, 21 nt, artificial
  Completely synthesized
caaauacuucucgacuuacuc

SEQ ID NO: 1551 - RNA, 21 nt, artificial
  Completely synthesized
agccgaagaaaccucauuguc

SEQ ID NO: 1552 - RNA, 21 nt, artificial
  Completely synthesized
aucaaaguacaaagcaucuga

SEQ ID NO: 1553 - RNA, 21 nt, artificial
  Completely synthesized
auuucuuuuuagccagauguc

SEQ ID NO: 1554 - RNA, 21 nt, artificial
  Completely synthesized
uuuuucuuaacaucuggcuuc

SEQ ID NO: 1555 - RNA, 21 nt, artificial
  Completely synthesized
acaucuggcuucuuacuuuug

SEQ ID NO: 1556 - RNA, 21 nt, artificial
  Completely synthesized
ucacuaggagaauaagguuuu

SEQ ID NO: 1557 - RNA, 21 nt, artificial
  Completely synthesized
uuauucuuaccccuccuacgu

SEQ ID NO: 1558 - RNA, 21 nt, artificial
  Completely synthesized
gaguuguucuugucuuuccuu

SEQ ID NO: 1559 - RNA, 21 nt, artificial
  Completely synthesized
cuugaauguuugucuuuugug

SEQ ID NO: 1560 - RNA, 21 nt, artificial
  Completely synthesized
uguuugucuuuugugaauggg

SEQ ID NO: 1561 - RNA, 21 nt, artificial
  Completely synthesized
uugucuuuugugaaugggguu

SEQ ID NO: 1562 - RNA, 21 nt, artificial
  Completely synthesized
aggcaauucuuucucuggugu

SEQ ID NO: 1563 - RNA, 21 nt, artificial
  Completely synthesized
caauucuuucucugguguguu

SEQ ID NO: 1564 - RNA, 21 nt, artificial
  Completely synthesized
uuuuaggaccauucuguuuga

SEQ ID NO: 1565 - RNA, 21 nt, artificial
  Completely synthesized
ucauacucuuuccgucgcuga

SEQ ID NO: 1566 - RNA, 21 nt, artificial
  Completely synthesized
aaucauugaauucugcugugc

SEQ ID NO: 1567 - RNA, 21 nt, artificial
  Completely synthesized
agggugguuuugguugaaagc

SEQ ID NO: 1568 - RNA, 21 nt, artificial
  Completely synthesized
aaaaucuguguugacuguggc

SEQ ID NO: 1569 - RNA, 21 nt, artificial
  Completely synthesized
ggcaucugaauuuaaugaguu

SEQ ID NO: 1570 - RNA, 21 nt, artificial
  Completely synthesized
uuuaaugaguucacugucaac

SEQ ID NO: 1571 - RNA, 21 nt, artificial
  Completely synthesized
aacucaggaauggauaauagc

SEQ ID NO: 1572 - RNA, 21 nt, artificial
  Completely synthesized
auaauagcuccucccaaacuu

SEQ ID NO: 1573 - RNA, 21 nt, artificial
  Completely synthesized
uaauagcuccucccaaacuug

SEQ ID NO: 1574 - RNA, 21 nt, artificial
  Completely synthesized
cugauuaguagcaaugaagac

SEQ ID NO: 1575 - RNA, 21 nt, artificial
  Completely synthesized
cgaagaaaccucauugucauc

SEQ ID NO: 1576 - RNA, 21 nt, artificial
  Completely synthesized
ucaaaguacaaagcaucugau

SEQ ID NO: 1577 - RNA, 21 nt, artificial
  Completely synthesized
aucugauuugggaaugugggc

SEQ ID NO: 1578 - RNA, 21 nt, artificial
  Completely synthesized
aguaugagcauuucacaucac

SEQ ID NO: 1579 - RNA, 21 nt, artificial
  Completely synthesized
uucacaucacaguaggagcuu

SEQ ID NO: 1580 - RNA, 21 nt, artificial
  Completely synthesized
uuuuccaucuucaucacguag

SEQ ID NO: 1581 - RNA, 21 nt, artificial
  Completely synthesized
uccaucuucaucacguagcau

SEQ ID NO: 1582 - RNA, 21 nt, artificial
  Completely synthesized
aggugcugaguuguuuuuuca

SEQ ID NO: 1583 - RNA, 21 nt, artificial
  Completely synthesized
aguuguuuuuucaguagguga

SEQ ID NO: 1584 - RNA, 21 nt, artificial
  Completely synthesized
uaaaucuugcucuaguucuac

SEQ ID NO: 1585 - RNA, 21 nt, artificial
  Completely synthesized
ucccgaauuaaugcaaguuga

SEQ ID NO: 1586 - RNA, 21 nt, artificial
  Completely synthesized
aguuguucuugucuuuccuuu

SEQ ID NO: 1587 - RNA, 21 nt, artificial
  Completely synthesized
auguuugucuuuugugaaugg

SEQ ID NO: 1588 - RNA, 21 nt, artificial
  Completely synthesized
ggcaauucuuucucuggugug

SEQ ID NO: 1589 - RNA, 21 nt, artificial
  Completely synthesized
guguuuuaggaccauucuguu

SEQ ID NO: 1590 - RNA, 21 nt, artificial
  Completely synthesized
uuuccagcucauacucuuucc

SEQ ID NO: 1591 - RNA, 21 nt, artificial
  Completely synthesized
uaaugaguucacugucaacug

SEQ ID NO: 1592 - RNA, 21 nt, artificial
  Completely synthesized
aaauacuucucgacuuacucc

SEQ ID NO: 1593 - RNA, 21 nt, artificial
  Completely synthesized
aauacuucucgacuuacucca

SEQ ID NO: 1594 - RNA, 21 nt, artificial
  Completely synthesized
auacuucucgacuuacuccaa

SEQ ID NO: 1595 - RNA, 21 nt, artificial
  Completely synthesized
uaacucaggaauggauaauag

SEQ ID NO: 1596 - RNA, 21 nt, artificial
  Completely synthesized
acuugcucaauguccuguugc

SEQ ID NO: 1597 - RNA, 21 nt, artificial
  Completely synthesized
uugcauaccgucuaaaucaac

SEQ ID NO: 1598 - RNA, 21 nt, artificial
  Completely synthesized
gauuaguagcaaugaagacug

SEQ ID NO: 1599 - RNA, 21 nt, artificial
  Completely synthesized
aagacugggcucucgauguga

SEQ ID NO: 1600 - RNA, 21 nt, artificial
  Completely synthesized
ugucaaucaaauccauguccu

SEQ ID NO: 1601 - RNA, 21 nt, artificial
  Completely synthesized
ucugauuugggaaugugggca

SEQ ID NO: 1602 - RNA, 21 nt, artificial
  Completely synthesized
aaugugggcaaccugggagua

SEQ ID NO: 1603 - RNA, 21 nt, artificial
  Completely synthesized
ccuuuauuaguaccagcucuu

SEQ ID NO: 1604 - RNA, 21 nt, artificial
  Completely synthesized
cuuuauuaguaccagcucuua

SEQ ID NO: 1605 - RNA, 21 nt, artificial
  Completely synthesized
ugccauuuuuuguccauacag

SEQ ID NO: 1606 - RNA, 21 nt, artificial
  Completely synthesized
agcucagaaaaggucaaaucc

SEQ ID NO: 1607 - RNA, 21 nt, artificial
  Completely synthesized
uucacuaggagaauaagguuu

SEQ ID NO: 1608 - RNA, 21 nt, artificial
  Completely synthesized
uaaggugcugaguuguuuuuu

SEQ ID NO: 1609 - RNA, 21 nt, artificial
  Completely synthesized
augaucuaaaucuugcucuag

SEQ ID NO: 1610 - RNA, 21 nt, artificial
  Completely synthesized
uuuccaguuuucuuuuucugc

SEQ ID NO: 1611 - RNA, 21 nt, artificial
  Completely synthesized
uaucccgaauuaaugcaaguu

SEQ ID NO: 1612 - RNA, 21 nt, artificial
  Completely synthesized
aucccgaauuaaugcaaguug

SEQ ID NO: 1613 - RNA, 21 nt, artificial
  Completely synthesized
ucuacagggaaugggauaugg

SEQ ID NO: 1614 - RNA, 21 nt, artificial
  Completely synthesized
gcuugaauguuugucuuuugu

SEQ ID NO: 1615 - RNA, 21 nt, artificial
  Completely synthesized
uuugucuuuugugaauggggu

SEQ ID NO: 1616 - RNA, 21 nt, artificial
  Completely synthesized
caggacuuacaggcaauucuu

SEQ ID NO: 1617 - RNA, 21 nt, artificial
  Completely synthesized
aggacuuacaggcaauucuuu

SEQ ID NO: 1618 - RNA, 21 nt, artificial
  Completely synthesized
aauucuuucucugguguguuc

SEQ ID NO: 1619 - RNA, 21 nt, artificial
  Completely synthesized
uguuuuuccagcucauacucu

SEQ ID NO: 1620 - RNA, 21 nt, artificial
  Completely synthesized
cauuaagaaaauguggacuac

SEQ ID NO: 1621 - RNA, 21 nt, artificial
  Completely synthesized
cauugaggguauagaugagua

SEQ ID NO: 1622 - RNA, 21 nt, artificial
  Completely synthesized
ccaaacuugcucaauguccug

SEQ ID NO: 1623 - RNA, 21 nt, artificial
  Completely synthesized
agugacugaaacguagccgaa

SEQ ID NO: 1624 - RNA, 21 nt, artificial
  Completely synthesized
uagccgaagaaaccucauugu

SEQ ID NO: 1625 - RNA, 21 nt, artificial
  Completely synthesized
augucaaucaaauccaugucc

SEQ ID NO: 1626 - RNA, 21 nt, artificial
  Completely synthesized
ccauuuuuuguccauacagua

SEQ ID NO: 1627 - RNA, 21 nt, artificial
  Completely synthesized
augguguccuaagaaauuguu

SEQ ID NO: 1628 - RNA, 21 nt, artificial
  Completely synthesized
guccuaagaaauuguuuacag

SEQ ID NO: 1629 - RNA, 21 nt, artificial
  Completely synthesized
agaauaagguuuuccaucuuc

SEQ ID NO: 1630 - RNA, 21 nt, artificial
  Completely synthesized
guuuuccaucuucaucacgua

SEQ ID NO: 1631 - RNA, 21 nt, artificial
  Completely synthesized
aacuucgagauauaaggugcu

SEQ ID NO: 1632 - RNA, 21 nt, artificial
  Completely synthesized
uauaaggugcugaguuguuuu

SEQ ID NO: 1633 - RNA, 21 nt, artificial
  Completely synthesized
caaaugaucuaaaucuugcuc

SEQ ID NO: 1634 - RNA, 21 nt, artificial
  Completely synthesized
ucuaaaucuugcucuaguucu

SEQ ID NO: 1635 - RNA, 21 nt, artificial
  Completely synthesized
uccaguuuucuuuuucugcaa

SEQ ID NO: 1636 - RNA, 21 nt, artificial
  Completely synthesized
cuacagggaaugggauaugga

SEQ ID NO: 1637 - RNA, 21 nt, artificial
  Completely synthesized
guuugucuuuugugaaugggg

SEQ ID NO: 1638 - RNA, 21 nt, artificial
  Completely synthesized
uucuuucucugguguguucuc

SEQ ID NO: 1639 - RNA, 21 nt, artificial
  Completely synthesized
uauccccagaagaauguacug

SEQ ID NO: 1640 - RNA, 21 nt, artificial
  Completely synthesized
uccagcucauacucuuuccgu

SEQ ID NO: 1641 - RNA, 21 nt, artificial
  Completely synthesized
uuagugaaaugccggagucag

SEQ ID NO: 1642 - RNA, 21 nt, artificial
  Completely synthesized
aucauugaauucugcugugcu

SEQ ID NO: 1643 - RNA, 21 nt, artificial
  Completely synthesized
ugacuguggcaucugaauuua

SEQ ID NO: 1644 - RNA, 21 nt, artificial
  Completely synthesized
guggcaucugaauuuaaugag

SEQ ID NO: 1645 - RNA, 21 nt, artificial
  Completely synthesized
uaagaaaauguggacuacagu

SEQ ID NO: 1646 - RNA, 21 nt, artificial
  Completely synthesized
accuacuucuuuuuccauuga

SEQ ID NO: 1647 - RNA, 21 nt, artificial
  Completely synthesized
cucaggaauggauaauagcuc

SEQ ID NO: 1648 - RNA, 21 nt, artificial
  Completely synthesized
aaacuugcucaauguccuguu

SEQ ID NO: 1649 - RNA, 21 nt, artificial
  Completely synthesized
guccuguugcauaccgucuaa

SEQ ID NO: 1650 - RNA, 21 nt, artificial
  Completely synthesized
uccuguugcauaccgucuaaa

SEQ ID NO: 1651 - RNA, 21 nt, artificial
  Completely synthesized
aacguagccgaagaaaccuca

SEQ ID NO: 1652 - RNA, 21 nt, artificial
  Completely synthesized
acguagccgaagaaaccucau

SEQ ID NO: 1653 - RNA, 21 nt, artificial
  Completely synthesized
cagucaucaaaguacaaagca

SEQ ID NO: 1654 - RNA, 21 nt, artificial
  Completely synthesized
ucaucaaaguacaaagcaucu

SEQ ID NO: 1655 - RNA, 21 nt, artificial
  Completely synthesized
aaucaaauccauguccugcug

SEQ ID NO: 1656 - RNA, 21 nt, artificial
  Completely synthesized
ugucucuucaucuaguuguaa

SEQ ID NO: 1657 - RNA, 21 nt, artificial
  Completely synthesized
uccuuuauuaguaccagcucu

SEQ ID NO: 1658 - RNA, 21 nt, artificial
  Completely synthesized
uuucuuuuuagccagauguca

SEQ ID NO: 1659 - RNA, 21 nt, artificial
  Completely synthesized
uuacacuuacacagaaacuag

SEQ ID NO: 1660 - RNA, 21 nt, artificial
  Completely synthesized
acacuuacacagaaacuagcc

SEQ ID NO: 1661 - RNA, 21 nt, artificial
  Completely synthesized
acuuacacagaaacuagccca

SEQ ID NO: 1662 - RNA, 21 nt, artificial
  Completely synthesized
ugguguccuaagaaauuguuu

SEQ ID NO: 1663 - RNA, 21 nt, artificial
  Completely synthesized
ugauucaacauacugacacuc

SEQ ID NO: 1664 - RNA, 21 nt, artificial
  Completely synthesized
ucacaguaggagcuuuuagua

SEQ ID NO: 1665 - RNA, 21 nt, artificial
  Completely synthesized
uuccaucuucaucacguagca

SEQ ID NO: 1666 - RNA, 21 nt, artificial
  Completely synthesized
aaacuucgagauauaaggugc

SEQ ID NO: 1667 - RNA, 21 nt, artificial
  Completely synthesized
acuucgagauauaaggugcug

SEQ ID NO: 1668 - RNA, 21 nt, artificial
  Completely synthesized
gaguuguuuuuucaguaggug

SEQ ID NO: 1669 - RNA, 21 nt, artificial
  Completely synthesized
gaucuaaaucuugcucuaguu

SEQ ID NO: 1670 - RNA, 21 nt, artificial
  Completely synthesized
aaucuugcucuaguucuacua

SEQ ID NO: 1671 - RNA, 21 nt, artificial
  Completely synthesized
uaccccuccuacguauauccc

SEQ ID NO: 1672 - RNA, 21 nt, artificial
  Completely synthesized
ucuuucucugguguguucuca

SEQ ID NO: 1673 - RNA, 21 nt, artificial
  Completely synthesized
uuuuuccagcucauacucuuu

SEQ ID NO: 1674 - RNA, 21 nt, artificial
  Completely synthesized
uuccagcucauacucuuuccg

SEQ ID NO: 1675 - RNA, 21 nt, artificial
  Completely synthesized
uguuugacacuuccaggggca

SEQ ID NO: 1676 - RNA, 21 nt, artificial
  Completely synthesized
ugacacuuccaggggcacuau

SEQ ID NO: 1677 - RNA, 21 nt, artificial
  Completely synthesized
gcucauacucuuuccgucgcu

SEQ ID NO: 1678 - RNA, 21 nt, artificial
  Completely synthesized
cucauacucuuuccgucgcug

SEQ ID NO: 1679 - RNA, 21 nt, artificial
  Completely synthesized
aucagaaacaucaaugggccc

SEQ ID NO: 1680 - RNA, 21 nt, artificial
  Completely synthesized
uuaagaaaauguggacuacag

SEQ ID NO: 1681 - RNA, 21 nt, artificial
  Completely synthesized
ccuacuucuuuuuccauugag

SEQ ID NO: 1682 - RNA, 21 nt, artificial
  Completely synthesized
uucucgacuuacuccaagauc

SEQ ID NO: 1683 - RNA, 21 nt, artificial
  Completely synthesized
aucuauaucuugccuccaaag

SEQ ID NO: 1684 - RNA, 21 nt, artificial
  Completely synthesized
cucccaaacuugcucaauguc

SEQ ID NO: 1685 - RNA, 21 nt, artificial
  Completely synthesized
ucccaaacuugcucaaugucc

SEQ ID NO: 1686 - RNA, 21 nt, artificial
  Completely synthesized
gcaacagaaguuucaggugac

SEQ ID NO: 1687 - RNA, 21 nt, artificial
  Completely synthesized
uaguagcaaugaagacugggc

SEQ ID NO: 1688 - RNA, 21 nt, artificial
  Completely synthesized
caaugaagacugggcucucga

SEQ ID NO: 1689 - RNA, 21 nt, artificial
  Completely synthesized
aagugacugaaacguagccga

SEQ ID NO: 1690 - RNA, 21 nt, artificial
  Completely synthesized
aaacguagccgaagaaaccuc

SEQ ID NO: 1691 - RNA, 21 nt, artificial
  Completely synthesized
caugcagucaucaaaguacaa

SEQ ID NO: 1692 - RNA, 21 nt, artificial
  Completely synthesized
agucaucaaaguacaaagcau

SEQ ID NO: 1693 - RNA, 21 nt, artificial
  Completely synthesized
gucaucaaaguacaaagcauc

SEQ ID NO: 1694 - RNA, 21 nt, artificial
  Completely synthesized
uucaccugucucuucaucuag

SEQ ID NO: 1695 - RNA, 21 nt, artificial
  Completely synthesized
aaugccauuuuuuguccauac

SEQ ID NO: 1696 - RNA, 21 nt, artificial
  Completely synthesized
augccauuuuuuguccauaca

SEQ ID NO: 1697 - RNA, 21 nt, artificial
  Completely synthesized
aaugguguccuaagaaauugu

SEQ ID NO: 1698 - RNA, 21 nt, artificial
  Completely synthesized
aaguaugagcauuucacauca

SEQ ID NO: 1699 - RNA, 21 nt, artificial
  Completely synthesized
gcauuucacaucacaguagga

SEQ ID NO: 1700 - RNA, 21 nt, artificial
  Completely synthesized
ugcagggaguauucacuagga

SEQ ID NO: 1701 - RNA, 21 nt, artificial
  Completely synthesized
augaugagcuguggaccgugu

SEQ ID NO: 1702 - RNA, 21 nt, artificial
  Completely synthesized
gaccauucuguuugacacuuc

SEQ ID NO: 1703 - RNA, 21 nt, artificial
  Completely synthesized
ccauucuguuugacacuucca

SEQ ID NO: 1704 - RNA, 21 nt, artificial
  Completely synthesized
gcucuuccacuucagaaucac

SEQ ID NO: 1705 - RNA, 21 nt, artificial
  Completely synthesized
auugaauucugcugugcuuuc

SEQ ID NO: 1706 - RNA, 21 nt, artificial
  Completely synthesized
ccaaaaucuguguugacugug

SEQ ID NO: 1707 - RNA, 21 nt, artificial
  Completely synthesized
cuucugucaguuuggcuucug

SEQ ID NO: 1708 - RNA, 21 nt, artificial
  Completely synthesized
ugagcaacagaaguuucaggu

SEQ ID NO: 1709 - RNA, 21 nt, artificial
  Completely synthesized
cuugccuccaaaguaugucaa

SEQ ID NO: 1710 - RNA, 21 nt, artificial
  Completely synthesized
ccuccaaaguaugucaaucaa

SEQ ID NO: 1711 - RNA, 21 nt, artificial
  Completely synthesized
ggaauaucaggaacaagugac

SEQ ID NO: 1712 - RNA, 21 nt, artificial
  Completely synthesized
gcagucaucaaaguacaaagc

SEQ ID NO: 1713 - RNA, 21 nt, artificial
  Completely synthesized
gucaaucaaauccauguccug

SEQ ID NO: 1714 - RNA, 21 nt, artificial
  Completely synthesized
cucuucaucuaguuguaacug

SEQ ID NO: 1715 - RNA, 21 nt, artificial
  Completely synthesized
uuuuuagccagaugucauauc

SEQ ID NO: 1716 - RNA, 21 nt, artificial
  Completely synthesized
aacuacugauucaacauacug

SEQ ID NO: 1717 - RNA, 21 nt, artificial
  Completely synthesized
acauacugacacuccaaugcu

SEQ ID NO: 1718 - RNA, 21 nt, artificial
  Completely synthesized
auacugacacuccaaugcuuu

SEQ ID NO: 1719 - RNA, 21 nt, artificial
  Completely synthesized
agcauuucacaucacaguagg

SEQ ID NO: 1720 - RNA, 21 nt, artificial
  Completely synthesized
aaacuagcucagaaaagguca

SEQ ID NO: 1721 - RNA, 21 nt, artificial
  Completely synthesized
uagcucagaaaaggucaaauc

SEQ ID NO: 1722 - RNA, 21 nt, artificial
  Completely synthesized
ucuucaucacguagcaugcug

SEQ ID NO: 1723 - RNA, 21 nt, artificial
  Completely synthesized
aaaacuucgagauauaaggug

SEQ ID NO: 1724 - RNA, 21 nt, artificial
  Completely synthesized
cuucgagauauaaggugcuga

SEQ ID NO: 1725 - RNA, 21 nt, artificial
  Completely synthesized
ucgagauauaaggugcugagu

SEQ ID NO: 1726 - RNA, 21 nt, artificial
  Completely synthesized
aucuugcucuaguucuacuau

SEQ ID NO: 1727 - RNA, 21 nt, artificial
  Completely synthesized
uuaccccuccuacguauaucc

SEQ ID NO: 1728 - RNA, 21 nt, artificial
  Completely synthesized
gaaugggauauggagagcuuu

SEQ ID NO: 1729 - RNA, 21 nt, artificial
  Completely synthesized
ugggauauggagagcuuuugc

SEQ ID NO: 1730 - RNA, 21 nt, artificial
  Completely synthesized
uuuugcccuaaguucaucucu

SEQ ID NO: 1731 - RNA, 21 nt, artificial
  Completely synthesized
uugcccuaaguucaucucuug

SEQ ID NO: 1732 - RNA, 21 nt, artificial
  Completely synthesized
cccuaaguucaucucuuguga

SEQ ID NO: 1733 - RNA, 21 nt, artificial
  Completely synthesized
accauucuguuugacacuucc

SEQ ID NO: 1734 - RNA, 21 nt, artificial
  Completely synthesized
auucuguuugacacuuccagg

SEQ ID NO: 1735 - RNA, 21 nt, artificial
  Completely synthesized
uagcucuuccacuucagaauc

SEQ ID NO: 1736 - RNA, 21 nt, artificial
  Completely synthesized
agcucauacucuuuccgucgc

SEQ ID NO: 1737 - RNA, 21 nt, artificial
  Completely synthesized
uugcaaagugauagaucagaa

SEQ ID NO: 1738 - RNA, 21 nt, artificial
  Completely synthesized
cuucucgacuuacuccaagau

SEQ ID NO: 1739 - RNA, 21 nt, artificial
  Completely synthesized
aacuugcucaauguccuguug

SEQ ID NO: 1740 - RNA, 21 nt, artificial
  Completely synthesized
agcaacagaaguuucagguga

SEQ ID NO: 1741 - RNA, 21 nt, artificial
  Completely synthesized
aaugaagacugggcucucgau

SEQ ID NO: 1742 - RNA, 21 nt, artificial
  Completely synthesized
ggaacaagugacugaaacgua

SEQ ID NO: 1743 - RNA, 21 nt, artificial
  Completely synthesized
aacaagugacugaaacguagc

SEQ ID NO: 1744 - RNA, 21 nt, artificial
  Completely synthesized
acaagugacugaaacguagcc

SEQ ID NO: 1745 - RNA, 21 nt, artificial
  Completely synthesized
caagugacugaaacguagccg

SEQ ID NO: 1746 - RNA, 21 nt, artificial
  Completely synthesized
acugaaacguagccgaagaaa

SEQ ID NO: 1747 - RNA, 21 nt, artificial
  Completely synthesized
uaugucaaucaaauccauguc

SEQ ID NO: 1748 - RNA, 21 nt, artificial
  Completely synthesized
cuuuuuagccagaugucauau

SEQ ID NO: 1749 - RNA, 21 nt, artificial
  Completely synthesized
cuuacacagaaacuagcccaa

SEQ ID NO: 1750 - RNA, 21 nt, artificial
  Completely synthesized
cuacugauucaacauacugac

SEQ ID NO: 1751 - RNA, 21 nt, artificial
  Completely synthesized
uacugauucaacauacugaca

SEQ ID NO: 1752 - RNA, 21 nt, artificial
  Completely synthesized
acugauucaacauacugacac

SEQ ID NO: 1753 - RNA, 21 nt, artificial
  Completely synthesized
uucaacauacugacacuccaa

SEQ ID NO: 1754 - RNA, 21 nt, artificial
  Completely synthesized
ugagcauuucacaucacagua

SEQ ID NO: 1755 - RNA, 21 nt, artificial
  Completely synthesized
aaaaacuagcucagaaaaggu

SEQ ID NO: 1756 - RNA, 21 nt, artificial
  Completely synthesized
acuagcucagaaaaggucaaa

SEQ ID NO: 1757 - RNA, 21 nt, artificial
  Completely synthesized
ugccaucucuuguuugcugca

SEQ ID NO: 1758 - RNA, 21 nt, artificial
  Completely synthesized
gcagggaguauucacuaggag

SEQ ID NO: 1759 - RNA, 21 nt, artificial
  Completely synthesized
caucuucaucacguagcaugc

SEQ ID NO: 1760 - RNA, 21 nt, artificial
  Completely synthesized
gaaaacuucgagauauaaggu

SEQ ID NO: 1761 - RNA, 21 nt, artificial
  Completely synthesized
ccuacguauaucccgaauuaa

SEQ ID NO: 1762 - RNA, 21 nt, artificial
  Completely synthesized
ucuuuggacaucauuucguug

SEQ ID NO: 1763 - RNA, 21 nt, artificial
  Completely synthesized
gaagucaacaacagggagguu

SEQ ID NO: 1764 - RNA, 21 nt, artificial
  Completely synthesized
cuuuugcccuaaguucaucuc

SEQ ID NO: 1765 - RNA, 21 nt, artificial
  Completely synthesized
ugcccuaaguucaucucuugu

SEQ ID NO: 1766 - RNA, 21 nt, artificial
  Completely synthesized
cauugaauucugcugugcuuu

SEQ ID NO: 1767 - RNA, 21 nt, artificial
  Completely synthesized
aagugauagaucagaaacauc

SEQ ID NO: 1768 - RNA, 21 nt, artificial
  Completely synthesized
accaaaaucuguguugacugu

SEQ ID NO: 1769 - RNA, 21 nt, artificial
  Completely synthesized
augcugcugaaggaauccuca

SEQ ID NO: 1770 - RNA, 21 nt, artificial
  Completely synthesized
ucuugccuccaaaguauguca

SEQ ID NO: 1771 - RNA, 21 nt, artificial
  Completely synthesized
aguaugucaaucaaauccaug

SEQ ID NO: 1772 - RNA, 21 nt, artificial
  Completely synthesized
ucaaucaaauccauguccugc

SEQ ID NO: 1773 - RNA, 21 nt, artificial
  Completely synthesized
gaaauucaccugucucuucau

SEQ ID NO: 1774 - RNA, 21 nt, artificial
  Completely synthesized
aauucaccugucucuucaucu

SEQ ID NO: 1775 - RNA, 21 nt, artificial
  Completely synthesized
acauagugguuaguuuugcaa

SEQ ID NO: 1776 - RNA, 21 nt, artificial
  Completely synthesized
uucuuuuuagccagaugucau

SEQ ID NO: 1777 - RNA, 21 nt, artificial
  Completely synthesized
cacuuacacagaaacuagccc

SEQ ID NO: 1778 - RNA, 21 nt, artificial
  Completely synthesized
uuacacagaaacuagcccaaa

SEQ ID NO: 1779 - RNA, 21 nt, artificial
  Completely synthesized
gauucaacauacugacacucc

SEQ ID NO: 1780 - RNA, 21 nt, artificial
  Completely synthesized
guaugagcauuucacaucaca

SEQ ID NO: 1781 - RNA, 21 nt, artificial
  Completely synthesized
uucgagauauaaggugcugag

SEQ ID NO: 1782 - RNA, 21 nt, artificial
  Completely synthesized
uccuacguauaucccgaauua

SEQ ID NO: 1783 - RNA, 21 nt, artificial
  Completely synthesized
uuuggaguuguucuugucuuu

SEQ ID NO: 1784 - RNA, 21 nt, artificial
  Completely synthesized
uuggaguuguucuugucuuuc

SEQ ID NO: 1785 - RNA, 21 nt, artificial
  Completely synthesized
ugcucuuuggacaucauuucg

SEQ ID NO: 1786 - RNA, 21 nt, artificial
  Completely synthesized
cucuuuggacaucauuucguu

SEQ ID NO: 1787 - RNA, 21 nt, artificial
  Completely synthesized
ugaagucaacaacagggaggu

SEQ ID NO: 1788 - RNA, 21 nt, artificial
  Completely synthesized
aacaacagggagguuaaugau

SEQ ID NO: 1789 - RNA, 21 nt, artificial
  Completely synthesized
ugcaaagugauagaucagaaa

SEQ ID NO: 1790 - RNA, 21 nt, artificial
  Completely synthesized
cgggaauaucaggaacaagug

SEQ ID NO: 1791 - RNA, 21 nt, artificial
  Completely synthesized
ccaaaguaugucaaucaaauc

SEQ ID NO: 1792 - RNA, 21 nt, artificial
  Completely synthesized
aggaacaagugacugaaacgu

SEQ ID NO: 1793 - RNA, 21 nt, artificial
  Completely synthesized
aauugggagaaauucaccugu

SEQ ID NO: 1794 - RNA, 21 nt, artificial
  Completely synthesized
auccuuuauuaguaccagcuc

SEQ ID NO: 1795 - RNA, 21 nt, artificial
  Completely synthesized
uaugagcauuucacaucacag

SEQ ID NO: 1796 - RNA, 21 nt, artificial
  Completely synthesized
uccuccuaaaucuaguuuuuc

SEQ ID NO: 1797 - RNA, 21 nt, artificial
  Completely synthesized
uuuucuccuuuuucuuugagc

SEQ ID NO: 1798 - RNA, 21 nt, artificial
  Completely synthesized
cuuuuggaguuguucuugucu

SEQ ID NO: 1799 - RNA, 21 nt, artificial
  Completely synthesized
cccuccuacguauaucccgaa

SEQ ID NO: 1800 - RNA, 21 nt, artificial
  Completely synthesized
auugaacugcucuuuggacau

SEQ ID NO: 1801 - RNA, 21 nt, artificial
  Completely synthesized
ugaacugcucuuuggacauca

SEQ ID NO: 1802 - RNA, 21 nt, artificial
  Completely synthesized
uuuuuucuguuuuuccagcuc

SEQ ID NO: 1803 - RNA, 21 nt, artificial
  Completely synthesized
uuguguuuagugaaaugccgg

SEQ ID NO: 1804 - RNA, 21 nt, artificial
  Completely synthesized
gugauagaucagaaacaucaa

SEQ ID NO: 1805 - RNA, 21 nt, artificial
  Completely synthesized
auagaucagaaacaucaaugg

SEQ ID NO: 1806 - RNA, 21 nt, artificial
  Completely synthesized
uagaucagaaacaucaauggg

SEQ ID NO: 1807 - RNA, 21 nt, artificial
  Completely synthesized
gaucagaaacaucaaugggcc

SEQ ID NO: 1808 - RNA, 21 nt, artificial
  Completely synthesized
gacuacaguuaccuacuucuu

SEQ ID NO: 1809 - RNA, 21 nt, artificial
  Completely synthesized
aaaacuagcucagaaaagguc

SEQ ID NO: 1810 - RNA, 21 nt, artificial
  Completely synthesized
gcaugcugaaaacuucgagau

SEQ ID NO: 1811 - RNA, 21 nt, artificial
  Completely synthesized
uuuuggaguuguucuugucuu

SEQ ID NO: 1812 - RNA, 21 nt, artificial
  Completely synthesized
ucuuuugugaaugggguuuuc

SEQ ID NO: 1813 - RNA, 21 nt, artificial
  Completely synthesized
ugacaaggguuguaccauauc

SEQ ID NO: 1814 - RNA, 21 nt, artificial
  Completely synthesized
acuaucuagcucuuccacuuc

SEQ ID NO: 1815 - RNA, 21 nt, artificial
  Completely synthesized
gcaaagugauagaucagaaac

SEQ ID NO: 1816 - RNA, 21 nt, artificial
  Completely synthesized
agaucagaaacaucaaugggc

SEQ ID NO: 1817 - RNA, 21 nt, artificial
  Completely synthesized
cugauuugggaaugugggcaa

SEQ ID NO: 1818 - RNA, 21 nt, artificial
  Completely synthesized
ugauuugggaaugugggcaac

SEQ ID NO: 1819 - RNA, 21 nt, artificial
  Completely synthesized
uugccaucucuuguuugcugc

SEQ ID NO: 1820 - RNA, 21 nt, artificial
  Completely synthesized
uuucuccuuuuucuuugagca

SEQ ID NO: 1821 - RNA, 21 nt, artificial
  Completely synthesized
aauuaaugcaaguugagcuuc

SEQ ID NO: 1822 - RNA, 21 nt, artificial
  Completely synthesized
gcuucauugaacugcucuuug

SEQ ID NO: 1823 - RNA, 21 nt, artificial
  Completely synthesized
cuuuugugaaugggguuuucc

SEQ ID NO: 1824 - RNA, 21 nt, artificial
  Completely synthesized
uuuuucuguuuuuccagcuca

SEQ ID NO: 1825 - RNA, 21 nt, artificial
  Completely synthesized
augcuguugcugauacugggc

SEQ ID NO: 1826 - RNA, 21 nt, artificial
  Completely synthesized
aauguggacuacaguuaccua

SEQ ID NO: 1827 - RNA, 21 nt, artificial
  Completely synthesized
agacacuguaacucaggaaug

SEQ ID NO: 1828 - RNA, 21 nt, artificial
  Completely synthesized
cucauugucaucuacaaacgg

SEQ ID NO: 1829 - RNA, 21 nt, artificial
  Completely synthesized
uaauccuuuauuaguaccagc

SEQ ID NO: 1830 - RNA, 21 nt, artificial
  Completely synthesized
aacuagcccaaaugguguccu

SEQ ID NO: 1831 - RNA, 21 nt, artificial
  Completely synthesized
agggaaugggauauggagagc

SEQ ID NO: 1832 - RNA, 21 nt, artificial
  Completely synthesized
ucagaaacaucaaugggccca

SEQ ID NO: 1833 - RNA, 21 nt, artificial
  Completely synthesized
agagagugaauggcuuaaagu

SEQ ID NO: 1834 - RNA, 21 nt, artificial
  Completely synthesized
aauggcuuaaaguagcaggug

SEQ ID NO: 1835 - RNA, 21 nt, artificial
  Completely synthesized
uggcuuaaaguagcaggugag

SEQ ID NO: 1836 - RNA, 21 nt, artificial
  Completely synthesized
ucaaccagcuugucauuuuca

SEQ ID NO: 1837 - RNA, 21 nt, artificial
  Completely synthesized
aauccuuuauuaguaccagcu

SEQ ID NO: 1838 - RNA, 21 nt, artificial
  Completely synthesized
guuuuggcuaugauuuugcau

SEQ ID NO: 1839 - RNA, 21 nt, artificial
  Completely synthesized
aacauugccaucucuuguuug

SEQ ID NO: 1840 - RNA, 21 nt, artificial
  Completely synthesized
gugaaggcuuuugucauuuuc

SEQ ID NO: 1841 - RNA, 21 nt, artificial
  Completely synthesized
gucuuuugugaaugggguuuu

SEQ ID NO: 1842 - RNA, 21 nt, artificial
  Completely synthesized
uuuucuguuuuuccagcucau

SEQ ID NO: 1843 - RNA, 21 nt, artificial
  Completely synthesized
uaucuagcucuuccacuucag

SEQ ID NO: 1844 - RNA, 21 nt, artificial
  Completely synthesized
uguuuagugaaaugccggagu

SEQ ID NO: 1845 - RNA, 21 nt, artificial
  Completely synthesized
agaaguucagagagugaaugg

SEQ ID NO: 1846 - RNA, 21 nt, artificial
  Completely synthesized
aaguucagagagugaauggcu

SEQ ID NO: 1847 - RNA, 21 nt, artificial
  Completely synthesized
gugaauggcuuaaaguagcag

SEQ ID NO: 1848 - RNA, 21 nt, artificial
  Completely synthesized
auggcuuaaaguagcagguga

SEQ ID NO: 1849 - RNA, 21 nt, artificial
  Completely synthesized
uuaaaguagcaggugagggca

SEQ ID NO: 1850 - RNA, 21 nt, artificial
  Completely synthesized
uaaaguagcaggugagggcau

SEQ ID NO: 1851 - RNA, 21 nt, artificial
  Completely synthesized
guuaccuacuucuuuuuccau

SEQ ID NO: 1852 - RNA, 21 nt, artificial
  Completely synthesized
aacuucugucaguuuggcuuc

SEQ ID NO: 1853 - RNA, 21 nt, artificial
  Completely synthesized
ugacacuccaaugcuuuuuaa

SEQ ID NO: 1854 - RNA, 21 nt, artificial
  Completely synthesized
gggaacaaggaaaacauugcc

SEQ ID NO: 1855 - RNA, 21 nt, artificial
  Completely synthesized
agauauaaggugcugaguugu

SEQ ID NO: 1856 - RNA, 21 nt, artificial
  Completely synthesized
uuucugcaauucugagcagcc

SEQ ID NO: 1857 - RNA, 21 nt, artificial
  Completely synthesized
gggaaugggauauggagagcu

SEQ ID NO: 1858 - RNA, 21 nt, artificial
  Completely synthesized
ggaaugggauauggagagcuu

SEQ ID NO: 1859 - RNA, 21 nt, artificial
  Completely synthesized
agcggcuugaauguuugucuu

SEQ ID NO: 1860 - RNA, 21 nt, artificial
  Completely synthesized
ugucuuuugugaaugggguuu

SEQ ID NO: 1861 - RNA, 21 nt, artificial
  Completely synthesized
cuuguguuuagugaaaugccg

SEQ ID NO: 1862 - RNA, 21 nt, artificial
  Completely synthesized
ucauugucaucuacaaacggg

SEQ ID NO: 1863 - RNA, 21 nt, artificial
  Completely synthesized
cauugucaucuacaaacggga

SEQ ID NO: 1864 - RNA, 21 nt, artificial
  Completely synthesized
accugggaguaguuggcagau

SEQ ID NO: 1865 - RNA, 21 nt, artificial
  Completely synthesized
uaguuuuucuuaacaucuggc

SEQ ID NO: 1866 - RNA, 21 nt, artificial
  Completely synthesized
aggugaaggcuuuugucauuu

SEQ ID NO: 1867 - RNA, 21 nt, artificial
  Completely synthesized
uuuuucugcaauucugagcag

SEQ ID NO: 1868 - RNA, 21 nt, artificial
  Completely synthesized
gaauuaaugcaaguugagcuu

SEQ ID NO: 1869 - RNA, 21 nt, artificial
  Completely synthesized
ugaaugggguuuuccgaugac

SEQ ID NO: 1870 - RNA, 21 nt, artificial
  Completely synthesized
uucacugucaacugguugggg

SEQ ID NO: 1871 - RNA, 21 nt, artificial
  Completely synthesized
acaguuaccuacuucuuuuuc

SEQ ID NO: 1872 - RNA, 21 nt, artificial
  Completely synthesized
aguuaccuacuucuuuuucca

SEQ ID NO: 1873 - RNA, 21 nt, artificial
  Completely synthesized
ucaguuuggcuucuggacuug

SEQ ID NO: 1874 - RNA, 21 nt, artificial
  Completely synthesized
aauggauaauagcuccuccca

SEQ ID NO: 1875 - RNA, 21 nt, artificial
  Completely synthesized
uacauagugguuaguuuugca

SEQ ID NO: 1876 - RNA, 21 nt, artificial
  Completely synthesized
uaggagaauaagguuuuccau

SEQ ID NO: 1877 - RNA, 21 nt, artificial
  Completely synthesized
uuuuuucaguaggugaaggcu

SEQ ID NO: 1878 - RNA, 21 nt, artificial
  Completely synthesized
ggcuuuugucauuuucuccuu

SEQ ID NO: 1879 - RNA, 21 nt, artificial
  Completely synthesized
gcggcuugaauguuugucuuu

SEQ ID NO: 1880 - RNA, 21 nt, artificial
  Completely synthesized
uuuuccgaugaccaggacuua

SEQ ID NO: 1881 - RNA, 21 nt, artificial
  Completely synthesized
uuucuguuuuuccagcucaua

SEQ ID NO: 1882 - RNA, 21 nt, artificial
  Completely synthesized
ugagauggugacaaggguugu

SEQ ID NO: 1883 - RNA, 21 nt, artificial
  Completely synthesized
agauggugacaaggguuguac

SEQ ID NO: 1884 - RNA, 21 nt, artificial
  Completely synthesized
acugaggccaaguaguguguc

SEQ ID NO: 1885 - RNA, 21 nt, artificial
  Completely synthesized
cuuugcaaagugauagaucag

SEQ ID NO: 1886 - RNA, 21 nt, artificial
  Completely synthesized
ugaauggcuuaaaguagcagg

SEQ ID NO: 1887 - RNA, 21 nt, artificial
  Completely synthesized
acugaagucaaauacuucucg

SEQ ID NO: 1888 - RNA, 21 nt, artificial
  Completely synthesized
auugucaucuacaaacgggaa

SEQ ID NO: 1889 - RNA, 21 nt, artificial
  Completely synthesized
uacaaacgggaaugucugcgc

SEQ ID NO: 1890 - RNA, 21 nt, artificial
  Completely synthesized
ugggaguaguuggcagaucca

SEQ ID NO: 1891 - RNA, 21 nt, artificial
  Completely synthesized
uucaucuaguuguaacugagc

SEQ ID NO: 1892 - RNA, 21 nt, artificial
  Completely synthesized
uaguuuuggcuaugauuuugc

SEQ ID NO: 1893 - RNA, 21 nt, artificial
  Completely synthesized
aguacaaaaaaacuagcucag

SEQ ID NO: 1894 - RNA, 21 nt, artificial
  Completely synthesized
ucagaaaaggucaaauccucc

SEQ ID NO: 1895 - RNA, 21 nt, artificial
  Completely synthesized
agaaaaggucaaauccuccua

SEQ ID NO: 1896 - RNA, 21 nt, artificial
  Completely synthesized
uuuucugcaauucugagcagc

SEQ ID NO: 1897 - RNA, 21 nt, artificial
  Completely synthesized
ucugcaauucugagcagccac

SEQ ID NO: 1898 - RNA, 21 nt, artificial
  Completely synthesized
ugcaauucugagcagccacuu

SEQ ID NO: 1899 - RNA, 21 nt, artificial
  Completely synthesized
uguacugguguuuuaggacca

SEQ ID NO: 1900 - RNA, 21 nt, artificial
  Completely synthesized
acugguguuuuaggaccauuc

SEQ ID NO: 1901 - RNA, 21 nt, artificial
  Completely synthesized
cacuucagaaucacugaggcc

SEQ ID NO: 1902 - RNA, 21 nt, artificial
  Completely synthesized
ugugucuccauagcuggaaga

SEQ ID NO: 1903 - RNA, 21 nt, artificial
  Completely synthesized
acuuguguuuagugaaaugcc

SEQ ID NO: 1904 - RNA, 21 nt, artificial
  Completely synthesized
guuuagugaaaugccggaguc

SEQ ID NO: 1905 - RNA, 21 nt, artificial
  Completely synthesized
agugaauggcuuaaaguagca

SEQ ID NO: 1906 - RNA, 21 nt, artificial
  Completely synthesized
ucgcugacugaagucaaauac

SEQ ID NO: 1907 - RNA, 21 nt, artificial
  Completely synthesized
cuguugcugauacugggcuca

SEQ ID NO: 1908 - RNA, 21 nt, artificial
  Completely synthesized
gacugaagucaaauacuucuc

SEQ ID NO: 1909 - RNA, 21 nt, artificial
  Completely synthesized
cugaagucaaauacuucucga

SEQ ID NO: 1910 - RNA, 21 nt, artificial
  Completely synthesized
cugaauuuaaugaguucacug

SEQ ID NO: 1911 - RNA, 21 nt, artificial
  Completely synthesized
acuucugucaguuuggcuucu

SEQ ID NO: 1912 - RNA, 21 nt, artificial
  Completely synthesized
gaauggauaauagcuccuccc

SEQ ID NO: 1913 - RNA, 21 nt, artificial
  Completely synthesized
auggauaauagcuccucccaa

SEQ ID NO: 1914 - RNA, 21 nt, artificial
  Completely synthesized
accgucuaaaucaacaggggc

SEQ ID NO: 1915 - RNA, 21 nt, artificial
  Completely synthesized
auugggagaaauucaccuguc

SEQ ID NO: 1916 - RNA, 21 nt, artificial
  Completely synthesized
aguuuuggcuaugauuuugca

SEQ ID NO: 1917 - RNA, 21 nt, artificial
  Completely synthesized
ucuggcuucuuacuuuuggga

SEQ ID NO: 1918 - RNA, 21 nt, artificial
  Completely synthesized
gcuucuuacuuuugggaacaa

SEQ ID NO: 1919 - RNA, 21 nt, artificial
  Completely synthesized
ucuugcuccuuuuggaguugu

SEQ ID NO: 1920 - RNA, 21 nt, artificial
  Completely synthesized
uuuuuucuacagggaauggga

SEQ ID NO: 1921 - RNA, 21 nt, artificial
  Completely synthesized
gugaaugggguuuuccgauga

SEQ ID NO: 1922 - RNA, 21 nt, artificial
  Completely synthesized
uuacaggcaauucuuucucug

SEQ ID NO: 1923 - RNA, 21 nt, artificial
  Completely synthesized
aucaugcacgugagugcucug

SEQ ID NO: 1924 - RNA, 21 nt, artificial
  Completely synthesized
ccccagaagaauguacuggug

SEQ ID NO: 1925 - RNA, 21 nt, artificial
  Completely synthesized
uguguuuagugaaaugccgga

SEQ ID NO: 1926 - RNA, 21 nt, artificial
  Completely synthesized
uuuagugaaaugccggaguca

SEQ ID NO: 1927 - RNA, 21 nt, artificial
  Completely synthesized
gcuuaaaguagcaggugaggg

SEQ ID NO: 1928 - RNA, 21 nt, artificial
  Completely synthesized
cugucaguuuggcuucuggac

SEQ ID NO: 1929 - RNA, 21 nt, artificial
  Completely synthesized
accaugguagucucaaccagc

SEQ ID NO: 1930 - RNA, 21 nt, artificial
  Completely synthesized
uaagacacuguaacucaggaa

SEQ ID NO: 1931 - RNA, 21 nt, artificial
  Completely synthesized
uaccgucuaaaucaacagggg

SEQ ID NO: 1932 - RNA, 21 nt, artificial
  Completely synthesized
aguaguuggcagauccacugg

SEQ ID NO: 1933 - RNA, 21 nt, artificial
  Completely synthesized
uugggagaaauucaccugucu

SEQ ID NO: 1934 - RNA, 21 nt, artificial
  Completely synthesized
caucuaguuguaacugagcga

SEQ ID NO: 1935 - RNA, 21 nt, artificial
  Completely synthesized
cuaguuuuucuuaacaucugg

SEQ ID NO: 1936 - RNA, 21 nt, artificial
  Completely synthesized
aguuuuucuuaacaucuggcu

SEQ ID NO: 1937 - RNA, 21 nt, artificial
  Completely synthesized
gaacaaggaaaacauugccau

SEQ ID NO: 1938 - RNA, 21 nt, artificial
  Completely synthesized
aaggaaaacauugccaucucu

SEQ ID NO: 1939 - RNA, 21 nt, artificial
  Completely synthesized
uugcuccuuuuggaguuguuc

SEQ ID NO: 1940 - RNA, 21 nt, artificial
  Completely synthesized
ggauauggagagcuuuugccc

SEQ ID NO: 1941 - RNA, 21 nt, artificial
  Completely synthesized
uugugaaugggguuuuccgau

SEQ ID NO: 1942 - RNA, 21 nt, artificial
  Completely synthesized
cacauugggcaucaugcacgu

SEQ ID NO: 1943 - RNA, 21 nt, artificial
  Completely synthesized
auguacugguguuuuaggacc

SEQ ID NO: 1944 - RNA, 21 nt, artificial
  Completely synthesized
uacucuuuccgucgcugacug

SEQ ID NO: 1945 - RNA, 21 nt, artificial
  Completely synthesized
guguuuagugaaaugccggag

SEQ ID NO: 1946 - RNA, 21 nt, artificial
  Completely synthesized
uuuccgucgcugacugaaguc

SEQ ID NO: 1947 - RNA, 21 nt, artificial
  Completely synthesized
aguucagagagugaauggcuu

SEQ ID NO: 1948 - RNA, 21 nt, artificial
  Completely synthesized
uguugcugauacugggcucag

SEQ ID NO: 1949 - RNA, 21 nt, artificial
  Completely synthesized
gaauuuaaugaguucacuguc

SEQ ID NO: 1950 - RNA, 21 nt, artificial
  Completely synthesized
ugucaacugguuggggucuuc

SEQ ID NO: 1951 - RNA, 21 nt, artificial
  Completely synthesized
ucaacuucugucaguuuggcu

SEQ ID NO: 1952 - RNA, 21 nt, artificial
  Completely synthesized
caugguagucucaaccagcuu

SEQ ID NO: 1953 - RNA, 21 nt, artificial
  Completely synthesized
aggaauggauaauagcuccuc

SEQ ID NO: 1954 - RNA, 21 nt, artificial
  Completely synthesized
caucaugaugagcuguggacc

SEQ ID NO: 1955 - RNA, 21 nt, artificial
  Completely synthesized
ugacugagccugauuaguagc

SEQ ID NO: 1956 - RNA, 21 nt, artificial
  Completely synthesized
uuaguagcaaugaagacuggg

SEQ ID NO: 1957 - RNA, 21 nt, artificial
  Completely synthesized
aaaagcugcaugcagucauca

SEQ ID NO: 1958 - RNA, 21 nt, artificial
  Completely synthesized
ugggagaaauucaccugucuc

SEQ ID NO: 1959 - RNA, 21 nt, artificial
  Completely synthesized
ucuaguuguaacugagcgaaa

SEQ ID NO: 1960 - RNA, 21 nt, artificial
  Completely synthesized
uuuagccagaugucauaucau

SEQ ID NO: 1961 - RNA, 21 nt, artificial
  Completely synthesized
aaacuagcccaaauggugucc

SEQ ID NO: 1962 - RNA, 21 nt, artificial
  Completely synthesized
cuauacuaguuuuggcuauga

SEQ ID NO: 1963 - RNA, 21 nt, artificial
  Completely synthesized
guacaaaaaaacuagcucaga

SEQ ID NO: 1964 - RNA, 21 nt, artificial
  Completely synthesized
caaggaaaacauugccaucuc

SEQ ID NO: 1965 - RNA, 21 nt, artificial
  Completely synthesized
uuugcugcagggaguauucac

SEQ ID NO: 1966 - RNA, 21 nt, artificial
  Completely synthesized
auucacuaggagaauaagguu

SEQ ID NO: 1967 - RNA, 21 nt, artificial
  Completely synthesized
acuaggagaauaagguuuucc

SEQ ID NO: 1968 - RNA, 21 nt, artificial
  Completely synthesized
guuuuuucaguaggugaaggc

SEQ ID NO: 1969 - RNA, 21 nt, artificial
  Completely synthesized
cuuuuucugcaauucugagca

SEQ ID NO: 1970 - RNA, 21 nt, artificial
  Completely synthesized
cuguuuuuccagcucauacuc

SEQ ID NO: 1971 - RNA, 21 nt, artificial
  Completely synthesized
guacugguguuuuaggaccau

SEQ ID NO: 1972 - RNA, 21 nt, artificial
  Completely synthesized
cacugaggccaaguagugugu

SEQ ID NO: 1973 - RNA, 21 nt, artificial
  Completely synthesized
ugaggccaaguagugugucuc

SEQ ID NO: 1974 - RNA, 21 nt, artificial
  Completely synthesized
ggccaaguagugugucuccau

SEQ ID NO: 1975 - RNA, 21 nt, artificial
  Completely synthesized
aaguagugugucuccauagcu

SEQ ID NO: 1976 - RNA, 21 nt, artificial
  Completely synthesized
gacuuguguuuagugaaaugc

SEQ ID NO: 1977 - RNA, 21 nt, artificial
  Completely synthesized
acucuuuccgucgcugacuga

SEQ ID NO: 1978 - RNA, 21 nt, artificial
  Completely synthesized
uuagaaguucagagagugaau

SEQ ID NO: 1979 - RNA, 21 nt, artificial
  Completely synthesized
uucaucaccaaaaucuguguu

SEQ ID NO: 1980 - RNA, 21 nt, artificial
  Completely synthesized
aucaccaaaaucuguguugac

SEQ ID NO: 1981 - RNA, 21 nt, artificial
  Completely synthesized
gcaucugaauuuaaugaguuc

SEQ ID NO: 1982 - RNA, 21 nt, artificial
  Completely synthesized
augaguucacugucaacuggu

SEQ ID NO: 1983 - RNA, 21 nt, artificial
  Completely synthesized
aaauguggacuacaguuaccu

SEQ ID NO: 1984 - RNA, 21 nt, artificial
  Completely synthesized
ucuuuuuccauugaggguaua

SEQ ID NO: 1985 - RNA, 21 nt, artificial
  Completely synthesized
acacuguaacucaggaaugga

SEQ ID NO: 1986 - RNA, 21 nt, artificial
  Completely synthesized
ucaggaauggauaauagcucc

SEQ ID NO: 1987 - RNA, 21 nt, artificial
  Completely synthesized
caauguccuguugcauaccgu

SEQ ID NO: 1988 - RNA, 21 nt, artificial
  Completely synthesized
auaccgucuaaaucaacaggg

SEQ ID NO: 1989 - RNA, 21 nt, artificial
  Completely synthesized
gucuaaaucaacaggggcuac

SEQ ID NO: 1990 - RNA, 21 nt, artificial
  Completely synthesized
uaccugagcaacagaaguuuc

SEQ ID NO: 1991 - RNA, 21 nt, artificial
  Completely synthesized
agcaaugaagacugggcucuc

SEQ ID NO: 1992 - RNA, 21 nt, artificial
  Completely synthesized
aguuggcagauccacugguuu

SEQ ID NO: 1993 - RNA, 21 nt, artificial
  Completely synthesized
gaaaaggucaaauccuccuaa

SEQ ID NO: 1994 - RNA, 21 nt, artificial
  Completely synthesized
guuuuucuuaacaucuggcuu

SEQ ID NO: 1995 - RNA, 21 nt, artificial
  Completely synthesized
cuggcuucuuacuuuugggaa

SEQ ID NO: 1996 - RNA, 21 nt, artificial
  Completely synthesized
aaaaaggcuuucucuugcucc

SEQ ID NO: 1997 - RNA, 21 nt, artificial
  Completely synthesized
aacaaggaaaacauugccauc

SEQ ID NO: 1998 - RNA, 21 nt, artificial
  Completely synthesized
aaaggcuuucucuugcuccuu

SEQ ID NO: 1999 - RNA, 21 nt, artificial
  Completely synthesized
uuuuucaguaggugaaggcuu

SEQ ID NO: 2000 - RNA, 21 nt, artificial
  Completely synthesized
auuaaugcaaguugagcuuca

SEQ ID NO: 2001 - RNA, 21 nt, artificial
  Completely synthesized
uuaaugcaaguugagcuucau

SEQ ID NO: 2002 - RNA, 21 nt, artificial
  Completely synthesized
auuuuuucuacagggaauggg

SEQ ID NO: 2003 - RNA, 21 nt, artificial
  Completely synthesized
ucuugugagaugagccuccaa

SEQ ID NO: 2004 - RNA, 21 nt, artificial
  Completely synthesized
guuuuuucuguuuuuccagcu

SEQ ID NO: 2005 - RNA, 21 nt, artificial
  Completely synthesized
cucacauugggcaucaugcac

SEQ ID NO: 2006 - RNA, 21 nt, artificial
  Completely synthesized
acauugggcaucaugcacgug

SEQ ID NO: 2007 - RNA, 21 nt, artificial
  Completely synthesized
cccagaagaauguacuggugu

SEQ ID NO: 2008 - RNA, 21 nt, artificial
  Completely synthesized
aauguacugguguuuuaggac

SEQ ID NO: 2009 - RNA, 21 nt, artificial
  Completely synthesized
aggccaaguagugugucucca

SEQ ID NO: 2010 - RNA, 19 nt, artificial
  Completely synthesized
caaccaaaaccacccugaa

SEQ ID NO: 2011 - RNA, 19 nt, artificial
  Completely synthesized
ccaaaaggagcaagagaaa

SEQ ID NO: 2012 - RNA, 19 nt, artificial
  Completely synthesized
auugcaaaacuaaccacua

SEQ ID NO: 2013 - RNA, 19 nt, artificial
  Completely synthesized
gcuggaaaaacagaaaaaa

SEQ ID NO: 2014 - RNA, 19 nt, artificial
  Completely synthesized
agaugaagagacaggugaa

SEQ ID NO: 2015 - RNA, 19 nt, artificial
  Completely synthesized
cccugaaagcacagcagaa

SEQ ID NO: 2016 - RNA, 19 nt, artificial
  Completely synthesized
acuugaaaaggaaagacaa

SEQ ID NO: 2017 - RNA, 19 nt, artificial
  Completely synthesized
gcaguucaaugaagcucaa

SEQ ID NO: 2018 - RNA, 19 nt, artificial
  Completely synthesized
cauugauguuucugaucua

SEQ ID NO: 2019 - RNA, 19 nt, artificial
  Completely synthesized
caaaacuaaccacuaugua

SEQ ID NO: 2020 - RNA, 19 nt, artificial
  Completely synthesized
caaagagcaguucaaugaa

SEQ ID NO: 2021 - RNA, 19 nt, artificial
  Completely synthesized
ucacgugcaugaugcccaa

SEQ ID NO: 2022 - RNA, 19 nt, artificial
  Completely synthesized
ccuggaagugucaaacaga

SEQ ID NO: 2023 - RNA, 19 nt, artificial
  Completely synthesized
ugauuuagacgguaugcaa

SEQ ID NO: 2024 - RNA, 19 nt, artificial
  Completely synthesized
caacgaaaugauguccaaa

SEQ ID NO: 2025 - RNA, 19 nt, artificial
  Completely synthesized
caugguuccaaguccagaa

SEQ ID NO: 2026 - RNA, 19 nt, artificial
  Completely synthesized
caggcucagucaccugaaa

SEQ ID NO: 2027 - RNA, 19 nt, artificial
  Completely synthesized
cauggauuugauugacaua

SEQ ID NO: 2028 - RNA, 19 nt, artificial
  Completely synthesized
guuguugacuucaacgaaa

SEQ ID NO: 2029 - RNA, 19 nt, artificial
  Completely synthesized
ggcauuucacuaaacacaa

SEQ ID NO: 2030 - RNA, 19 nt, artificial
  Completely synthesized
ccaaccaguugacagugaa

SEQ ID NO: 2031 - RNA, 19 nt, artificial
  Completely synthesized
gcaaguuugggaggagcua

SEQ ID NO: 2032 - RNA, 19 nt, artificial
  Completely synthesized
uaugcaaaaucauagccaa

SEQ ID NO: 2033 - RNA, 19 nt, artificial
  Completely synthesized
agaaaaugacaaaagccuu

SEQ ID NO: 2034 - RNA, 19 nt, artificial
  Completely synthesized
agauauagaucuuggagua

SEQ ID NO: 2035 - RNA, 19 nt, artificial
  Completely synthesized
ccuuuuucgcucaguuaca

SEQ ID NO: 2036 - RNA, 19 nt, artificial
  Completely synthesized
ggagcaagagaaagccuuu

SEQ ID NO: 2037 - RNA, 19 nt, artificial
  Completely synthesized
agaguaugagcuggaaaaa

SEQ ID NO: 2038 - RNA, 19 nt, artificial
  Completely synthesized
gggcaaaagcucuccauau

SEQ ID NO: 2039 - RNA, 19 nt, artificial
  Completely synthesized
ugcaaagcuuucaaccaaa

SEQ ID NO: 2040 - RNA, 19 nt, artificial
  Completely synthesized
cugugaugugaaaugcuca

SEQ ID NO: 2041 - RNA, 19 nt, artificial
  Completely synthesized
cuacgugaugaagauggaa

SEQ ID NO: 2042 - RNA, 19 nt, artificial
  Completely synthesized
aaguccuggucaucggaaa

SEQ ID NO: 2043 - RNA, 19 nt, artificial
  Completely synthesized
ccaguaucagcaacagcau

SEQ ID NO: 2044 - RNA, 19 nt, artificial
  Completely synthesized
cccauucccuguagaaaaa

SEQ ID NO: 2045 - RNA, 19 nt, artificial
  Completely synthesized
cgugcaugaugcccaaugu

SEQ ID NO: 2046 - RNA, 19 nt, artificial
  Completely synthesized
caguguggcaucaccagaa

SEQ ID NO: 2047 - RNA, 19 nt, artificial
  Completely synthesized
acaggugaauuucucccaa

SEQ ID NO: 2048 - RNA, 19 nt, artificial
  Completely synthesized
gaaaaaggagaaaaugaca

SEQ ID NO: 2049 - RNA, 19 nt, artificial
  Completely synthesized
uguuguugacuucaacgaa

SEQ ID NO: 2050 - RNA, 19 nt, artificial
  Completely synthesized
cgaaguuuucagcaugcua

SEQ ID NO: 2051 - RNA, 19 nt, artificial
  Completely synthesized
aaaugauguccaaagagca

SEQ ID NO: 2052 - RNA, 19 nt, artificial
  Completely synthesized
gugagaacacaccagagaa

SEQ ID NO: 2053 - RNA, 19 nt, artificial
  Completely synthesized
gaaugguccuaaaacacca

SEQ ID NO: 2054 - RNA, 19 nt, artificial
  Completely synthesized
ugcucagaauugcagaaaa

SEQ ID NO: 2055 - RNA, 19 nt, artificial
  Completely synthesized
aguccuggucaucggaaaa

SEQ ID NO: 2056 - RNA, 19 nt, artificial
  Completely synthesized
agaucuuggaguaagucga

SEQ ID NO: 2057 - RNA, 19 nt, artificial
  Completely synthesized
aaagaaguagguaacugua

SEQ ID NO: 2058 - RNA, 19 nt, artificial
  Completely synthesized
gcaagauauagaucuugga

SEQ ID NO: 2059 - RNA, 19 nt, artificial
  Completely synthesized
ccaugguuccaaguccaga

SEQ ID NO: 2060 - RNA, 19 nt, artificial
  Completely synthesized
gccuucaccuacugaaaaa

SEQ ID NO: 2061 - RNA, 19 nt, artificial
  Completely synthesized
cuuggaggcucaucucaca

SEQ ID NO: 2062 - RNA, 19 nt, artificial
  Completely synthesized
gccuguaaguccuggucau

SEQ ID NO: 2063 - RNA, 19 nt, artificial
  Completely synthesized
aaacagaaugguccuaaaa

SEQ ID NO: 2064 - RNA, 19 nt, artificial
  Completely synthesized
agcuauuauccauuccuga

SEQ ID NO: 2065 - RNA, 19 nt, artificial
  Completely synthesized
acuuuggaggcaagauaua

SEQ ID NO: 2066 - RNA, 19 nt, artificial
  Completely synthesized
cgcucaguuacaacuagau

SEQ ID NO: 2067 - RNA, 19 nt, artificial
  Completely synthesized
gaauaaaguggcugcucag

SEQ ID NO: 2068 - RNA, 19 nt, artificial
  Completely synthesized
ucccauucccuguagaaaa

SEQ ID NO: 2069 - RNA, 19 nt, artificial
  Completely synthesized
aaagaguaugagcuggaaa

SEQ ID NO: 2070 - RNA, 19 nt, artificial
  Completely synthesized
ccagcacauccagucagaa

SEQ ID NO: 2071 - RNA, 19 nt, artificial
  Completely synthesized
aguuucuguguaaguguaa

SEQ ID NO: 2072 - RNA, 19 nt, artificial
  Completely synthesized
ggcucaucucacaagagau

SEQ ID NO: 2073 - RNA, 19 nt, artificial
  Completely synthesized
gucagcgacggaaagagua

SEQ ID NO: 2074 - RNA, 19 nt, artificial
  Completely synthesized
caggugaauuucucccaau

SEQ ID NO: 2075 - RNA, 19 nt, artificial
  Completely synthesized
uauugcaaaacuaaccacu

SEQ ID NO: 2076 - RNA, 19 nt, artificial
  Completely synthesized
aaaacaacucagcaccuua

SEQ ID NO: 2077 - RNA, 19 nt, artificial
  Completely synthesized
ggcugcucagaauugcaga

SEQ ID NO: 2078 - RNA, 19 nt, artificial
  Completely synthesized
cuucagucagcgacggaaa

SEQ ID NO: 2079 - RNA, 19 nt, artificial
  Completely synthesized
uggccucagugauucugaa

SEQ ID NO: 2080 - RNA, 19 nt, artificial
  Completely synthesized
cagcuauggagacacacua

SEQ ID NO: 2081 - RNA, 19 nt, artificial
  Completely synthesized
cagcauccucuccacagaa

SEQ ID NO: 2082 - RNA, 19 nt, artificial
  Completely synthesized
guuugggaggagcuauuau

SEQ ID NO: 2083 - RNA, 19 nt, artificial
  Completely synthesized
ccuguugauuuagacggua

SEQ ID NO: 2084 - RNA, 19 nt, artificial
  Completely synthesized
ucaucaugauggacuugga

SEQ ID NO: 2085 - RNA, 19 nt, artificial
  Completely synthesized
cauucccuguagaaaaaau

SEQ ID NO: 2086 - RNA, 19 nt, artificial
  Completely synthesized
gggauaugguacaacccuu

SEQ ID NO: 2087 - RNA, 19 nt, artificial
  Completely synthesized
aguggaagagcuagauagu

SEQ ID NO: 2088 - RNA, 19 nt, artificial
  Completely synthesized
gcaucaccagaacacucag

SEQ ID NO: 2089 - RNA, 19 nt, artificial
  Completely synthesized
gguugagacuaccaugguu

SEQ ID NO: 2090 - RNA, 19 nt, artificial
  Completely synthesized
cgcagacauucccguuugu

SEQ ID NO: 2091 - RNA, 19 nt, artificial
  Completely synthesized
gguugcccacauucccaaa

SEQ ID NO: 2092 - RNA, 19 nt, artificial
  Completely synthesized
uuaagagcugguacuaaua

SEQ ID NO: 2093 - RNA, 19 nt, artificial
  Completely synthesized
augcaaaaucauagccaaa

SEQ ID NO: 2094 - RNA, 19 nt, artificial
  Completely synthesized
cuaaaagcuccuacuguga

SEQ ID NO: 2095 - RNA, 19 nt, artificial
  Completely synthesized
caugaugcccaaugugaga

SEQ ID NO: 2096 - RNA, 19 nt, artificial
  Completely synthesized
gcauccucuccacagaaga

SEQ ID NO: 2097 - RNA, 19 nt, artificial
  Completely synthesized
agguaacuguaguccacau

SEQ ID NO: 2098 - RNA, 19 nt, artificial
  Completely synthesized
cagcuuuuggcgcagacau

SEQ ID NO: 2099 - RNA, 19 nt, artificial
  Completely synthesized
cugagcuaguuuuuuugua

SEQ ID NO: 2100 - RNA, 19 nt, artificial
  Completely synthesized
ggaggauuugaccuuuucu

SEQ ID NO: 2101 - RNA, 19 nt, artificial
  Completely synthesized
aagccuucaccuacugaaa

SEQ ID NO: 2102 - RNA, 19 nt, artificial
  Completely synthesized
uauaguagaacuagagcaa

SEQ ID NO: 2103 - RNA, 19 nt, artificial
  Completely synthesized
ccauucccuguagaaaaaa

SEQ ID NO: 2104 - RNA, 19 nt, artificial
  Completely synthesized
gguccacagcucaucauga

SEQ ID NO: 2105 - RNA, 19 nt, artificial
  Completely synthesized
uucugaaguggaagagcua

SEQ ID NO: 2106 - RNA, 19 nt, artificial
  Completely synthesized
ucuuggaguaagucgagaa

SEQ ID NO: 2107 - RNA, 19 nt, artificial
  Completely synthesized
uacccucaauggaaaaaga

SEQ ID NO: 2108 - RNA, 19 nt, artificial
  Completely synthesized
caaguuugggaggagcuau

SEQ ID NO: 2109 - RNA, 19 nt, artificial
  Completely synthesized
ccugauauucccggucaca

SEQ ID NO: 2110 - RNA, 19 nt, artificial
  Completely synthesized
guuuguagaugacaaugag

SEQ ID NO: 2111 - RNA, 19 nt, artificial
  Completely synthesized
aguggaucugccaacuacu

SEQ ID NO: 2112 - RNA, 19 nt, artificial
  Completely synthesized
acaagagauggcaauguuu

SEQ ID NO: 2113 - RNA, 19 nt, artificial
  Completely synthesized
cucccugcagcaaacaaga

SEQ ID NO: 2114 - RNA, 19 nt, artificial
  Completely synthesized
ccuuauucuccuagugaau

SEQ ID NO: 2115 - RNA, 19 nt, artificial
  Completely synthesized
aaaaggaaagacaagaaca

SEQ ID NO: 2116 - RNA, 19 nt, artificial
  Completely synthesized
acuccggcauuucacuaaa

SEQ ID NO: 2117 - RNA, 19 nt, artificial
  Completely synthesized
uauagaucuuggaguaagu

SEQ ID NO: 2118 - RNA, 19 nt, artificial
  Completely synthesized
uguaguccacauuuucuua

SEQ ID NO: 2119 - RNA, 19 nt, artificial
  Completely synthesized
gguuucuucggcuacguuu

SEQ ID NO: 2120 - RNA, 19 nt, artificial
  Completely synthesized
aggugaauuucucccaauu

SEQ ID NO: 2121 - RNA, 19 nt, artificial
  Completely synthesized
caagagauggcaauguuuu

SEQ ID NO: 2122 - RNA, 19 nt, artificial
  Completely synthesized
cauuaaccucccuguuguu

SEQ ID NO: 2123 - RNA, 19 nt, artificial
  Completely synthesized
agggcaaaagcucuccaua

SEQ ID NO: 2124 - RNA, 19 nt, artificial
  Completely synthesized
gcaugaugcccaaugugag

SEQ ID NO: 2125 - RNA, 19 nt, artificial
  Completely synthesized
aguccagaagccaaacuga

SEQ ID NO: 2126 - RNA, 19 nt, artificial
  Completely synthesized
cacagcucaucaugaugga

SEQ ID NO: 2127 - RNA, 19 nt, artificial
  Completely synthesized
ccugaguuacagugucuua

SEQ ID NO: 2128 - RNA, 19 nt, artificial
  Completely synthesized
aaaccaguggaucugccaa

SEQ ID NO: 2129 - RNA, 19 nt, artificial
  Completely synthesized
auaugacaucuggcuaaaa

SEQ ID NO: 2130 - RNA, 19 nt, artificial
  Completely synthesized
cauagccaaaacuaguaua

SEQ ID NO: 2131 - RNA, 19 nt, artificial
  Completely synthesized
ccuuguucccaaaaguaag

SEQ ID NO: 2132 - RNA, 19 nt, artificial
  Completely synthesized
agcaaacaagagauggcaa

SEQ ID NO: 2133 - RNA, 19 nt, artificial
  Completely synthesized
ccuucaccuacugaaaaaa

SEQ ID NO: 2134 - RNA, 19 nt, artificial
  Completely synthesized
gcugcucagaauugcagaa

SEQ ID NO: 2135 - RNA, 19 nt, artificial
  Completely synthesized
guccaaagagcaguucaau

SEQ ID NO: 2136 - RNA, 19 nt, artificial
  Completely synthesized
cacuuugcaaagcuuucaa

SEQ ID NO: 2137 - RNA, 19 nt, artificial
  Completely synthesized
auucagaugccacagucaa

SEQ ID NO: 2138 - RNA, 19 nt, artificial
  Completely synthesized
cccguuuguagaugacaau

SEQ ID NO: 2139 - RNA, 19 nt, artificial
  Completely synthesized
gaaaccaguggaucugcca

SEQ ID NO: 2140 - RNA, 19 nt, artificial
  Completely synthesized
guguggcaucaccagaaca

SEQ ID NO: 2141 - RNA, 19 nt, artificial
  Completely synthesized
cuaucacuuugcaaagcuu

SEQ ID NO: 2142 - RNA, 19 nt, artificial
  Completely synthesized
ucacucucugaacuucuaa

SEQ ID NO: 2143 - RNA, 19 nt, artificial
  Completely synthesized
cuauacccucaauggaaaa

SEQ ID NO: 2144 - RNA, 19 nt, artificial
  Completely synthesized
aguuugggaggagcuauua

SEQ ID NO: 2145 - RNA, 19 nt, artificial
  Completely synthesized
uguagaugacaaugagguu

SEQ ID NO: 2146 - RNA, 19 nt, artificial
  Completely synthesized
cuuuaaaaagcauuggagu

SEQ ID NO: 2147 - RNA, 19 nt, artificial
  Completely synthesized
auaaaguggcugcucagaa

SEQ ID NO: 2148 - RNA, 19 nt, artificial
  Completely synthesized
aacacaccagagaaagaau

SEQ ID NO: 2149 - RNA, 19 nt, artificial
  Completely synthesized
ucagcgacggaaagaguau

SEQ ID NO: 2150 - RNA, 19 nt, artificial
  Completely synthesized
cgagaaguauuugacuuca

SEQ ID NO: 2151 - RNA, 19 nt, artificial
  Completely synthesized
aauucagaugccacaguca

SEQ ID NO: 2152 - RNA, 19 nt, artificial
  Completely synthesized
aguagguaacuguagucca

SEQ ID NO: 2153 - RNA, 19 nt, artificial
  Completely synthesized
gcugguugagacuaccaug

SEQ ID NO: 2154 - RNA, 19 nt, artificial
  Completely synthesized
uauccauuccugaguuaca

SEQ ID NO: 2155 - RNA, 19 nt, artificial
  Completely synthesized
cccaguaucagcaacagca

SEQ ID NO: 2156 - RNA, 19 nt, artificial
  Completely synthesized
guugacagugaacucauua

SEQ ID NO: 2157 - RNA, 19 nt, artificial
  Completely synthesized
cugaguuacagugucuuaa

SEQ ID NO: 2158 - RNA, 19 nt, artificial
  Completely synthesized
uacuuuggaggcaagauau

SEQ ID NO: 2159 - RNA, 19 nt, artificial
  Completely synthesized
ggcucagucaccugaaacu

SEQ ID NO: 2160 - RNA, 19 nt, artificial
  Completely synthesized
agaugcuuuguacuuugau

SEQ ID NO: 2161 - RNA, 19 nt, artificial
  Completely synthesized
ugauaugacaucuggcuaa

SEQ ID NO: 2162 - RNA, 19 nt, artificial
  Completely synthesized
cuguguaaguguaaauacu

SEQ ID NO: 2163 - RNA, 19 nt, artificial
  Completely synthesized
cauuggagugucaguaugu

SEQ ID NO: 2164 - RNA, 19 nt, artificial
  Completely synthesized
caaaaguaagaagccagau

SEQ ID NO: 2165 - RNA, 19 nt, artificial
  Completely synthesized
gagaaaaugacaaaagccu

SEQ ID NO: 2166 - RNA, 19 nt, artificial
  Completely synthesized
cuugaaaaggaaagacaag

SEQ ID NO: 2167 - RNA, 19 nt, artificial
  Completely synthesized
cuugcauuaauucgggaua

SEQ ID NO: 2168 - RNA, 19 nt, artificial
  Completely synthesized
cgaaaugauguccaaagag

SEQ ID NO: 2169 - RNA, 19 nt, artificial
  Completely synthesized
cccuguuguugacuucaac

SEQ ID NO: 2170 - RNA, 19 nt, artificial
  Completely synthesized
aaaagcucuccauauccca

SEQ ID NO: 2171 - RNA, 19 nt, artificial
  Completely synthesized
aguggaaucuuccagcuau

SEQ ID NO: 2172 - RNA, 19 nt, artificial
  Completely synthesized
cacucaguggaaucuucca

SEQ ID NO: 2173 - RNA, 19 nt, artificial
  Completely synthesized
caaugauucugacuccggc

SEQ ID NO: 2174 - RNA, 19 nt, artificial
  Completely synthesized
ucuaaaugggcccauugau

SEQ ID NO: 2175 - RNA, 19 nt, artificial
  Completely synthesized
caaccaguugacagugaac

SEQ ID NO: 2176 - RNA, 19 nt, artificial
  Completely synthesized
gaggcaagauauagaucuu

SEQ ID NO: 2177 - RNA, 19 nt, artificial
  Completely synthesized
ucaggcucagucaccugaa

SEQ ID NO: 2178 - RNA, 19 nt, artificial
  Completely synthesized
cuucauugcuacuaaucag

SEQ ID NO: 2179 - RNA, 19 nt, artificial
  Completely synthesized
gugaauuucucccaauuca

SEQ ID NO: 2180 - RNA, 19 nt, artificial
  Completely synthesized
cucaguuacaacuagauga

SEQ ID NO: 2181 - RNA, 19 nt, artificial
  Completely synthesized
aaguaagaagccagauguu

SEQ ID NO: 2182 - RNA, 19 nt, artificial
  Completely synthesized
uguuuuccuuguucccaaa

SEQ ID NO: 2183 - RNA, 19 nt, artificial
  Completely synthesized
ccugcagcaaacaagagau

SEQ ID NO: 2184 - RNA, 19 nt, artificial
  Completely synthesized
gaugaagauggaaaaccuu

SEQ ID NO: 2185 - RNA, 19 nt, artificial
  Completely synthesized
guagaacuagagcaagauu

SEQ ID NO: 2186 - RNA, 19 nt, artificial
  Completely synthesized
caucuauacccucaaugga

SEQ ID NO: 2187 - RNA, 19 nt, artificial
  Completely synthesized
cuuuuucgcucaguuacaa

SEQ ID NO: 2188 - RNA, 19 nt, artificial
  Completely synthesized
uccaaaaggagcaagagaa

SEQ ID NO: 2189 - RNA, 19 nt, artificial
  Completely synthesized
agauggcaauguuuuccuu

SEQ ID NO: 2190 - RNA, 19 nt, artificial
  Completely synthesized
aacaacucagcaccuuaua

SEQ ID NO: 2191 - RNA, 19 nt, artificial
  Completely synthesized
cgacggaaagaguaugagc

SEQ ID NO: 2192 - RNA, 19 nt, artificial
  Completely synthesized
ccaaugugagaacacacca

SEQ ID NO: 2193 - RNA, 19 nt, artificial
  Completely synthesized
cuacuuuaagccauucacu

SEQ ID NO: 2194 - RNA, 19 nt, artificial
  Completely synthesized
cauugagcaaguuugggag

SEQ ID NO: 2195 - RNA, 19 nt, artificial
  Completely synthesized
gauuuagacgguaugcaac

SEQ ID NO: 2196 - RNA, 19 nt, artificial
  Completely synthesized
cauacuuuggaggcaagau

SEQ ID NO: 2197 - RNA, 19 nt, artificial
  Completely synthesized
ucuucauugcuacuaauca

SEQ ID NO: 2198 - RNA, 19 nt, artificial
  Completely synthesized
caguauguugaaucaguag

SEQ ID NO: 2199 - RNA, 19 nt, artificial
  Completely synthesized
agcauuggagugucaguau

SEQ ID NO: 2200 - RNA, 19 nt, artificial
  Completely synthesized
aaagcauuggagugucagu

SEQ ID NO: 2201 - RNA, 19 nt, artificial
  Completely synthesized
cccugcagcaaacaagaga

SEQ ID NO: 2202 - RNA, 19 nt, artificial
  Completely synthesized
acaacucagcaccuuauau

SEQ ID NO: 2203 - RNA, 19 nt, artificial
  Completely synthesized
aguagaacuagagcaagau

SEQ ID NO: 2204 - RNA, 19 nt, artificial
  Completely synthesized
guggcugcucagaauugca

SEQ ID NO: 2205 - RNA, 19 nt, artificial
  Completely synthesized
guaugagcuggaaaaacag

SEQ ID NO: 2206 - RNA, 19 nt, artificial
  Completely synthesized
cugacuccggcauuucacu

SEQ ID NO: 2207 - RNA, 19 nt, artificial
  Completely synthesized
agcucaucaugauggacuu

SEQ ID NO: 2208 - RNA, 19 nt, artificial
  Completely synthesized
cagaauucaaugauucuga

SEQ ID NO: 2209 - RNA, 19 nt, artificial
  Completely synthesized
guuucugaucuaucacuuu

SEQ ID NO: 2210 - RNA, 19 nt, artificial
  Completely synthesized
cugagcccaguaucagcaa

SEQ ID NO: 2211 - RNA, 19 nt, artificial
  Completely synthesized
ucauuaaauucagaugcca

SEQ ID NO: 2212 - RNA, 19 nt, artificial
  Completely synthesized
ggaggcaagauauagaucu

SEQ ID NO: 2213 - RNA, 19 nt, artificial
  Completely synthesized
cauugcuacuaaucaggcu

SEQ ID NO: 2214 - RNA, 19 nt, artificial
  Completely synthesized
agcccagucuucauugcua

SEQ ID NO: 2215 - RNA, 19 nt, artificial
  Completely synthesized
cagucacuuguuccugaua

SEQ ID NO: 2216 - RNA, 19 nt, artificial
  Completely synthesized
cuccaaaaggagcaagaga

SEQ ID NO: 2217 - RNA, 19 nt, artificial
  Completely synthesized
uccuuguucccaaaaguaa

SEQ ID NO: 2218 - RNA, 19 nt, artificial
  Completely synthesized
agccuucaccuacugaaaa

SEQ ID NO: 2219 - RNA, 19 nt, artificial
  Completely synthesized
ugacaaaagccuucaccua

SEQ ID NO: 2220 - RNA, 19 nt, artificial
  Completely synthesized
gaaaaugacaaaagccuuc

SEQ ID NO: 2221 - RNA, 19 nt, artificial
  Completely synthesized
ugaagcucaacuugcauua

SEQ ID NO: 2222 - RNA, 19 nt, artificial
  Completely synthesized
ucaucucacaagagaugaa

SEQ ID NO: 2223 - RNA, 19 nt, artificial
  Completely synthesized
acuacuuggccucagugau

SEQ ID NO: 2224 - RNA, 19 nt, artificial
  Completely synthesized
caguggaaucuuccagcua

SEQ ID NO: 2225 - RNA, 19 nt, artificial
  Completely synthesized
agaaguauuugacuucagu

SEQ ID NO: 2226 - RNA, 19 nt, artificial
  Completely synthesized
auuaaauucagaugccaca

SEQ ID NO: 2227 - RNA, 19 nt, artificial
  Completely synthesized
gcuuuugaggauuccuuca

SEQ ID NO: 2228 - RNA, 19 nt, artificial
  Completely synthesized
guagguaacuguaguccac

SEQ ID NO: 2229 - RNA, 19 nt, artificial
  Completely synthesized
guaugcaacaggacauuga

SEQ ID NO: 2230 - RNA, 19 nt, artificial
  Completely synthesized
acauacuuuggaggcaaga

SEQ ID NO: 2231 - RNA, 19 nt, artificial
  Completely synthesized
cugauauucccggucacau

SEQ ID NO: 2232 - RNA, 19 nt, artificial
  Completely synthesized
cauccagucagaaaccagu

SEQ ID NO: 2233 - RNA, 19 nt, artificial
  Completely synthesized
uuuucagcaugcuacguga

SEQ ID NO: 2234 - RNA, 19 nt, artificial
  Completely synthesized
caucaugauggacuuggag

SEQ ID NO: 2235 - RNA, 19 nt, artificial
  Completely synthesized
guacaacccuugucaccau

SEQ ID NO: 2236 - RNA, 19 nt, artificial
  Completely synthesized
acccugaaagcacagcaga

SEQ ID NO: 2237 - RNA, 19 nt, artificial
  Completely synthesized
aagccauucacucucugaa

SEQ ID NO: 2238 - RNA, 19 nt, artificial
  Completely synthesized
auagcugagcccaguauca

SEQ ID NO: 2239 - RNA, 19 nt, artificial
  Completely synthesized
augccacagucaacacaga

SEQ ID NO: 2240 - RNA, 19 nt, artificial
  Completely synthesized
aacugacagaaguugacaa

SEQ ID NO: 2241 - RNA, 19 nt, artificial
  Completely synthesized
ugacaagcugguugagacu

SEQ ID NO: 2242 - RNA, 19 nt, artificial
  Completely synthesized
cccagucuucauugcuacu

SEQ ID NO: 2243 - RNA, 19 nt, artificial
  Completely synthesized
acaucgagagcccagucuu

SEQ ID NO: 2244 - RNA, 19 nt, artificial
  Completely synthesized
ccaguggaucugccaacua

SEQ ID NO: 2245 - RNA, 19 nt, artificial
  Completely synthesized
uuuuaagagcugguacuaa

SEQ ID NO: 2246 - RNA, 19 nt, artificial
  Completely synthesized
cauuaauucgggauauacg

SEQ ID NO: 2247 - RNA, 19 nt, artificial
  Completely synthesized
guaaguccuggucaucgga

SEQ ID NO: 2248 - RNA, 19 nt, artificial
  Completely synthesized
ugcccaaugugagaacaca

SEQ ID NO: 2249 - RNA, 19 nt, artificial
  Completely synthesized
ggauaugguacaacccuug

SEQ ID NO: 2250 - RNA, 19 nt, artificial
  Completely synthesized
ggaaucuuccagcuaugga

SEQ ID NO: 2251 - RNA, 19 nt, artificial
  Completely synthesized
aaugauucugacuccggca

SEQ ID NO: 2252 - RNA, 19 nt, artificial
  Completely synthesized
ccugaaagcacagcagaau

SEQ ID NO: 2253 - RNA, 19 nt, artificial
  Completely synthesized
gaucuuggaguaagucgag

SEQ ID NO: 2254 - RNA, 19 nt, artificial
  Completely synthesized
ccucaauggaaaaagaagu

SEQ ID NO: 2255 - RNA, 19 nt, artificial
  Completely synthesized
cccucaauggaaaaagaag

SEQ ID NO: 2256 - RNA, 19 nt, artificial
  Completely synthesized
acccucaauggaaaaagaa

SEQ ID NO: 2257 - RNA, 19 nt, artificial
  Completely synthesized
aaugagguuucuucggcua

SEQ ID NO: 2258 - RNA, 19 nt, artificial
  Completely synthesized
augacugcaugcagcuuuu

SEQ ID NO: 2259 - RNA, 19 nt, artificial
  Completely synthesized
ucaguuacaacuagaugaa

SEQ ID NO: 2260 - RNA, 19 nt, artificial
  Completely synthesized
acaauuucuuaggacacca

SEQ ID NO: 2261 - RNA, 19 nt, artificial
  Completely synthesized
aggauuugaccuuuucuga

SEQ ID NO: 2262 - RNA, 19 nt, artificial
  Completely synthesized
aaagccuucaccuacugaa

SEQ ID NO: 2263 - RNA, 19 nt, artificial
  Completely synthesized
ggagaaaaugacaaaagcc

SEQ ID NO: 2264 - RNA, 19 nt, artificial
  Completely synthesized
acuucagucagcgacggaa

SEQ ID NO: 2265 - RNA, 19 nt, artificial
  Completely synthesized
cacacuacuuggccucagu

SEQ ID NO: 2266 - RNA, 19 nt, artificial
  Completely synthesized
agaagccaaacugacagaa

SEQ ID NO: 2267 - RNA, 19 nt, artificial
  Completely synthesized
cgguaugcaacaggacauu

SEQ ID NO: 2268 - RNA, 19 nt, artificial
  Completely synthesized
auuuagacgguaugcaaca

SEQ ID NO: 2269 - RNA, 19 nt, artificial
  Completely synthesized
cccuguugauuuagacggu

SEQ ID NO: 2270 - RNA, 19 nt, artificial
  Completely synthesized
aacuucuguugcucaggua

SEQ ID NO: 2271 - RNA, 19 nt, artificial
  Completely synthesized
agccuuuuucgcucaguua

SEQ ID NO: 2272 - RNA, 19 nt, artificial
  Completely synthesized
augacaucuggcuaaaaag

SEQ ID NO: 2273 - RNA, 19 nt, artificial
  Completely synthesized
guguaaguguaaauacuac

SEQ ID NO: 2274 - RNA, 19 nt, artificial
  Completely synthesized
aaucauagccaaaacuagu

SEQ ID NO: 2275 - RNA, 19 nt, artificial
  Completely synthesized
acaacuccaaaaggagcaa

SEQ ID NO: 2276 - RNA, 19 nt, artificial
  Completely synthesized
gugaauacucccugcagca

SEQ ID NO: 2277 - RNA, 19 nt, artificial
  Completely synthesized
aaaugacaaaagccuucac

SEQ ID NO: 2278 - RNA, 19 nt, artificial
  Completely synthesized
gcauuaauucgggauauac

SEQ ID NO: 2279 - RNA, 19 nt, artificial
  Completely synthesized
aaagcucuccauaucccau

SEQ ID NO: 2280 - RNA, 19 nt, artificial
  Completely synthesized
aggcucaucucacaagaga

SEQ ID NO: 2281 - RNA, 19 nt, artificial
  Completely synthesized
ccagcuauggagacacacu

SEQ ID NO: 2282 - RNA, 19 nt, artificial
  Completely synthesized
cuuggaguaagucgagaag

SEQ ID NO: 2283 - RNA, 19 nt, artificial
  Completely synthesized
ggugaugaauuuuauucug

SEQ ID NO: 2284 - RNA, 19 nt, artificial
  Completely synthesized
cagauuuuggugaugaauu

SEQ ID NO: 2285 - RNA, 19 nt, artificial
  Completely synthesized
cagaaguugacaauuauca

SEQ ID NO: 2286 - RNA, 19 nt, artificial
  Completely synthesized
uucagggugguuuugguug

SEQ ID NO: 2287 - RNA, 19 nt, artificial
  Completely synthesized
uuucucuugcuccuuuugg

SEQ ID NO: 2288 - RNA, 19 nt, artificial
  Completely synthesized
uagugguuaguuuugcaau

SEQ ID NO: 2289 - RNA, 19 nt, artificial
  Completely synthesized
uuuuuucuguuuuuccagc

SEQ ID NO: 2290 - RNA, 19 nt, artificial
  Completely synthesized
uucaccugucucuucaucu

SEQ ID NO: 2291 - RNA, 19 nt, artificial
  Completely synthesized
uucugcugugcuuucaggg

SEQ ID NO: 2292 - RNA, 19 nt, artificial
  Completely synthesized
uugucuuuccuuuucaagu

SEQ ID NO: 2293 - RNA, 19 nt, artificial
  Completely synthesized
uugagcuucauugaacugc

SEQ ID NO: 2294 - RNA, 19 nt, artificial
  Completely synthesized
uagaucagaaacaucaaug

SEQ ID NO: 2295 - RNA, 19 nt, artificial
  Completely synthesized
uacauagugguuaguuuug

SEQ ID NO: 2296 - RNA, 19 nt, artificial
  Completely synthesized
uucauugaacugcucuuug

SEQ ID NO: 2297 - RNA, 19 nt, artificial
  Completely synthesized
uugggcaucaugcacguga

SEQ ID NO: 2298 - RNA, 19 nt, artificial
  Completely synthesized
ucuguuugacacuuccagg

SEQ ID NO: 2299 - RNA, 19 nt, artificial
  Completely synthesized
uugcauaccgucuaaauca

SEQ ID NO: 2300 - RNA, 19 nt, artificial
  Completely synthesized
uuuggacaucauuucguug

SEQ ID NO: 2301 - RNA, 19 nt, artificial
  Completely synthesized
uucuggacuuggaaccaug

SEQ ID NO: 2302 - RNA, 19 nt, artificial
  Completely synthesized
uuucaggugacugagccug

SEQ ID NO: 2303 - RNA, 19 nt, artificial
  Completely synthesized
uaugucaaucaaauccaug

SEQ ID NO: 2304 - RNA, 19 nt, artificial
  Completely synthesized
uuucguugaagucaacaac

SEQ ID NO: 2305 - RNA, 19 nt, artificial
  Completely synthesized
uuguguuuagugaaaugcc

SEQ ID NO: 2306 - RNA, 19 nt, artificial
  Completely synthesized
uucacugucaacugguugg

SEQ ID NO: 2307 - RNA, 19 nt, artificial
  Completely synthesized
uagcuccucccaaacuugc

SEQ ID NO: 2308 - RNA, 19 nt, artificial
  Completely synthesized
uuggcuaugauuuugcaua

SEQ ID NO: 2309 - RNA, 19 nt, artificial
  Completely synthesized
aaggcuuuugucauuuucu

SEQ ID NO: 2310 - RNA, 19 nt, artificial
  Completely synthesized
uacuccaagaucuauaucu

SEQ ID NO: 2311 - RNA, 19 nt, artificial
  Completely synthesized
uguaacugagcgaaaaagg

SEQ ID NO: 2312 - RNA, 19 nt, artificial
  Completely synthesized
aaaggcuuucucuugcucc

SEQ ID NO: 2313 - RNA, 19 nt, artificial
  Completely synthesized
uuuuuccagcucauacucu

SEQ ID NO: 2314 - RNA, 19 nt, artificial
  Completely synthesized
auauggagagcuuuugccc

SEQ ID NO: 2315 - RNA, 19 nt, artificial
  Completely synthesized
uuugguugaaagcuuugca

SEQ ID NO: 2316 - RNA, 19 nt, artificial
  Completely synthesized
ugagcauuucacaucacag

SEQ ID NO: 2317 - RNA, 19 nt, artificial
  Completely synthesized
uuccaucuucaucacguag

SEQ ID NO: 2318 - RNA, 19 nt, artificial
  Completely synthesized
uuuccgaugaccaggacuu

SEQ ID NO: 2319 - RNA, 19 nt, artificial
  Completely synthesized
augcuguugcugauacugg

SEQ ID NO: 2320 - RNA, 19 nt, artificial
  Completely synthesized
uuuuucuacagggaauggg

SEQ ID NO: 2321 - RNA, 19 nt, artificial
  Completely synthesized
acauugggcaucaugcacg

SEQ ID NO: 2322 - RNA, 19 nt, artificial
  Completely synthesized
uucuggugaugccacacug

SEQ ID NO: 2323 - RNA, 19 nt, artificial
  Completely synthesized
uugggagaaauucaccugu

SEQ ID NO: 2324 - RNA, 19 nt, artificial
  Completely synthesized
ugucauuuucuccuuuuuc

SEQ ID NO: 2325 - RNA, 19 nt, artificial
  Completely synthesized
uucguugaagucaacaaca

SEQ ID NO: 2326 - RNA, 19 nt, artificial
  Completely synthesized
uagcaugcugaaaacuucg

SEQ ID NO: 2327 - RNA, 19 nt, artificial
  Completely synthesized
ugcucuuuggacaucauuu

SEQ ID NO: 2328 - RNA, 19 nt, artificial
  Completely synthesized
uucucugguguguucucac

SEQ ID NO: 2329 - RNA, 19 nt, artificial
  Completely synthesized
ugguguuuuaggaccauuc

SEQ ID NO: 2330 - RNA, 19 nt, artificial
  Completely synthesized
uuuucugcaauucugagca

SEQ ID NO: 2331 - RNA, 19 nt, artificial
  Completely synthesized
uuuuccgaugaccaggacu

SEQ ID NO: 2332 - RNA, 19 nt, artificial
  Completely synthesized
ucgacuuacuccaagaucu

SEQ ID NO: 2333 - RNA, 19 nt, artificial
  Completely synthesized
uacaguuaccuacuucuuu

SEQ ID NO: 2334 - RNA, 19 nt, artificial
  Completely synthesized
uccaagaucuauaucuugc

SEQ ID NO: 2335 - RNA, 19 nt, artificial
  Completely synthesized
ucuggacuuggaaccaugg

SEQ ID NO: 2336 - RNA, 19 nt, artificial
  Completely synthesized
uuuuucaguaggugaaggc

SEQ ID NO: 2337 - RNA, 19 nt, artificial
  Completely synthesized
ugugagaugagccuccaag

SEQ ID NO: 2338 - RNA, 19 nt, artificial
  Completely synthesized
augaccaggacuuacaggc

SEQ ID NO: 2339 - RNA, 19 nt, artificial
  Completely synthesized
uuuuaggaccauucuguuu

SEQ ID NO: 2340 - RNA, 19 nt, artificial
  Completely synthesized
ucaggaauggauaauagcu

SEQ ID NO: 2341 - RNA, 19 nt, artificial
  Completely synthesized
uauaucuugccuccaaagu

SEQ ID NO: 2342 - RNA, 19 nt, artificial
  Completely synthesized
aucuaguuguaacugagcg

SEQ ID NO: 2343 - RNA, 19 nt, artificial
  Completely synthesized
cugagcagccacuuuauuc

SEQ ID NO: 2344 - RNA, 19 nt, artificial
  Completely synthesized
uuuucuacagggaauggga

SEQ ID NO: 2345 - RNA, 19 nt, artificial
  Completely synthesized
uuuccagcucauacucuuu

SEQ ID NO: 2346 - RNA, 19 nt, artificial
  Completely synthesized
uucugacuggaugugcugg

SEQ ID NO: 2347 - RNA, 19 nt, artificial
  Completely synthesized
uuacacuuacacagaaacu

SEQ ID NO: 2348 - RNA, 19 nt, artificial
  Completely synthesized
aucucuugugagaugagcc

SEQ ID NO: 2349 - RNA, 19 nt, artificial
  Completely synthesized
uacucuuuccgucgcugac

SEQ ID NO: 2350 - RNA, 19 nt, artificial
  Completely synthesized
auugggagaaauucaccug

SEQ ID NO: 2351 - RNA, 19 nt, artificial
  Completely synthesized
agugguuaguuuugcaaua

SEQ ID NO: 2352 - RNA, 19 nt, artificial
  Completely synthesized
uaaggugcugaguuguuuu

SEQ ID NO: 2353 - RNA, 19 nt, artificial
  Completely synthesized
ucugcaauucugagcagcc

SEQ ID NO: 2354 - RNA, 19 nt, artificial
  Completely synthesized
uuuccgucgcugacugaag

SEQ ID NO: 2355 - RNA, 19 nt, artificial
  Completely synthesized
uucagaaucacugaggcca

SEQ ID NO: 2356 - RNA, 19 nt, artificial
  Completely synthesized
uagugugucuccauagcug

SEQ ID NO: 2357 - RNA, 19 nt, artificial
  Completely synthesized
uucuguggagaggaugcug

SEQ ID NO: 2358 - RNA, 19 nt, artificial
  Completely synthesized
auaauagcuccucccaaac

SEQ ID NO: 2359 - RNA, 19 nt, artificial
  Completely synthesized
uaccgucuaaaucaacagg

SEQ ID NO: 2360 - RNA, 19 nt, artificial
  Completely synthesized
uccaaguccaucaugauga

SEQ ID NO: 2361 - RNA, 19 nt, artificial
  Completely synthesized
auuuuuucuacagggaaug

SEQ ID NO: 2362 - RNA, 19 nt, artificial
  Completely synthesized
aaggguuguaccauauccc

SEQ ID NO: 2363 - RNA, 19 nt, artificial
  Completely synthesized
acuaucuagcucuuccacu

SEQ ID NO: 2364 - RNA, 19 nt, artificial
  Completely synthesized
cugaguguucuggugaugc

SEQ ID NO: 2365 - RNA, 19 nt, artificial
  Completely synthesized
aaccaugguagucucaacc

SEQ ID NO: 2366 - RNA, 19 nt, artificial
  Completely synthesized
acaaacgggaaugucugcg

SEQ ID NO: 2367 - RNA, 19 nt, artificial
  Completely synthesized
uuugggaaugugggcaacc

SEQ ID NO: 2368 - RNA, 19 nt, artificial
  Completely synthesized
uauuaguaccagcucuuaa

SEQ ID NO: 2369 - RNA, 19 nt, artificial
  Completely synthesized
uuuggcuaugauuuugcau

SEQ ID NO: 2370 - RNA, 19 nt, artificial
  Completely synthesized
ucacaguaggagcuuuuag

SEQ ID NO: 2371 - RNA, 19 nt, artificial
  Completely synthesized
ucucacauugggcaucaug

SEQ ID NO: 2372 - RNA, 19 nt, artificial
  Completely synthesized
ucuucuguggagaggaugc

SEQ ID NO: 2373 - RNA, 19 nt, artificial
  Completely synthesized
auguggacuacaguuaccu

SEQ ID NO: 2374 - RNA, 19 nt, artificial
  Completely synthesized
augucugcgccaaaagcug

SEQ ID NO: 2375 - RNA, 19 nt, artificial
  Completely synthesized
uacaaaaaaacuagcucag

SEQ ID NO: 2376 - RNA, 19 nt, artificial
  Completely synthesized
agaaaaggucaaauccucc

SEQ ID NO: 2377 - RNA, 19 nt, artificial
  Completely synthesized
uuucaguaggugaaggcuu

SEQ ID NO: 2378 - RNA, 19 nt, artificial
  Completely synthesized
uugcucuaguucuacuaua

SEQ ID NO: 2379 - RNA, 19 nt, artificial
  Completely synthesized
uuuuuucuacagggaaugg

SEQ ID NO: 2380 - RNA, 19 nt, artificial
  Completely synthesized
ucaugaugagcuguggacc

SEQ ID NO: 2381 - RNA, 19 nt, artificial
  Completely synthesized
uagcucuuccacuucagaa

SEQ ID NO: 2382 - RNA, 19 nt, artificial
  Completely synthesized
uucucgacuuacuccaaga

SEQ ID NO: 2383 - RNA, 19 nt, artificial
  Completely synthesized
ucuuuuuccauugagggua

SEQ ID NO: 2384 - RNA, 19 nt, artificial
  Completely synthesized
auagcuccucccaaacuug

SEQ ID NO: 2385 - RNA, 19 nt, artificial
  Completely synthesized
ugugaccgggaauaucagg

SEQ ID NO: 2386 - RNA, 19 nt, artificial
  Completely synthesized
cucauugucaucuacaaac

SEQ ID NO: 2387 - RNA, 19 nt, artificial
  Completely synthesized
aguaguuggcagauccacu

SEQ ID NO: 2388 - RNA, 19 nt, artificial
  Completely synthesized
aaacauugccaucucuugu

SEQ ID NO: 2389 - RNA, 19 nt, artificial
  Completely synthesized
ucuuguuugcugcagggag

SEQ ID NO: 2390 - RNA, 19 nt, artificial
  Completely synthesized
auucacuaggagaauaagg

SEQ ID NO: 2391 - RNA, 19 nt, artificial
  Completely synthesized
uguucuugucuuuccuuuu

SEQ ID NO: 2392 - RNA, 19 nt, artificial
  Completely synthesized
uuuagugaaaugccggagu

SEQ ID NO: 2393 - RNA, 19 nt, artificial
  Completely synthesized
acuuacuccaagaucuaua

SEQ ID NO: 2394 - RNA, 19 nt, artificial
  Completely synthesized
uaagaaaauguggacuaca

SEQ ID NO: 2395 - RNA, 19 nt, artificial
  Completely synthesized
aaacguagccgaagaaacc

SEQ ID NO: 2396 - RNA, 19 nt, artificial
  Completely synthesized
aauugggagaaauucaccu

SEQ ID NO: 2397 - RNA, 19 nt, artificial
  Completely synthesized
aaaacauugccaucucuug

SEQ ID NO: 2398 - RNA, 19 nt, artificial
  Completely synthesized
aacaacagggagguuaaug

SEQ ID NO: 2399 - RNA, 19 nt, artificial
  Completely synthesized
uauggagagcuuuugcccu

SEQ ID NO: 2400 - RNA, 19 nt, artificial
  Completely synthesized
cucacauugggcaucaugc

SEQ ID NO: 2401 - RNA, 19 nt, artificial
  Completely synthesized
ucaguuuggcuucuggacu

SEQ ID NO: 2402 - RNA, 19 nt, artificial
  Completely synthesized
uccaucaugaugagcugug

SEQ ID NO: 2403 - RNA, 19 nt, artificial
  Completely synthesized
uaagacacuguaacucagg

SEQ ID NO: 2404 - RNA, 19 nt, artificial
  Completely synthesized
uuggcagauccacugguuu

SEQ ID NO: 2405 - RNA, 19 nt, artificial
  Completely synthesized
uuuuagccagaugucauau

SEQ ID NO: 2406 - RNA, 19 nt, artificial
  Completely synthesized
uauacuaguuuuggcuaug

SEQ ID NO: 2407 - RNA, 19 nt, artificial
  Completely synthesized
cuuacuuuugggaacaagg

SEQ ID NO: 2408 - RNA, 19 nt, artificial
  Completely synthesized
uugccaucucuuguuugcu

SEQ ID NO: 2409 - RNA, 19 nt, artificial
  Completely synthesized
uuuuuucaguaggugaagg

SEQ ID NO: 2410 - RNA, 19 nt, artificial
  Completely synthesized
uucugcaauucugagcagc

SEQ ID NO: 2411 - RNA, 19 nt, artificial
  Completely synthesized
auugaacugcucuuuggac

SEQ ID NO: 2412 - RNA, 19 nt, artificial
  Completely synthesized
uugaaagcuuugcaaagug

SEQ ID NO: 2413 - RNA, 19 nt, artificial
  Completely synthesized
uugacuguggcaucugaau

SEQ ID NO: 2414 - RNA, 19 nt, artificial
  Completely synthesized
auugucaucuacaaacggg

SEQ ID NO: 2415 - RNA, 19 nt, artificial
  Completely synthesized
uggcagauccacugguuuc

SEQ ID NO: 2416 - RNA, 19 nt, artificial
  Completely synthesized
uguucuggugaugccacac

SEQ ID NO: 2417 - RNA, 19 nt, artificial
  Completely synthesized
aagcuuugcaaagugauag

SEQ ID NO: 2418 - RNA, 19 nt, artificial
  Completely synthesized
uuagaaguucagagaguga

SEQ ID NO: 2419 - RNA, 19 nt, artificial
  Completely synthesized
uuuuccauugaggguauag

SEQ ID NO: 2420 - RNA, 19 nt, artificial
  Completely synthesized
uaauagcuccucccaaacu

SEQ ID NO: 2421 - RNA, 19 nt, artificial
  Completely synthesized
aaccucauugucaucuaca

SEQ ID NO: 2422 - RNA, 19 nt, artificial
  Completely synthesized
acuccaaugcuuuuuaaag

SEQ ID NO: 2423 - RNA, 19 nt, artificial
  Completely synthesized
uucugagcagccacuuuau

SEQ ID NO: 2424 - RNA, 19 nt, artificial
  Completely synthesized
auucuuucucugguguguu

SEQ ID NO: 2425 - RNA, 19 nt, artificial
  Completely synthesized
auacucuuuccgucgcuga

SEQ ID NO: 2426 - RNA, 19 nt, artificial
  Completely synthesized
ugaagucaaauacuucucg

SEQ ID NO: 2427 - RNA, 19 nt, artificial
  Completely synthesized
ugacuguggcaucugaauu

SEQ ID NO: 2428 - RNA, 19 nt, artificial
  Completely synthesized
uggacuacaguuaccuacu

SEQ ID NO: 2429 - RNA, 19 nt, artificial
  Completely synthesized
caugguagucucaaccagc

SEQ ID NO: 2430 - RNA, 19 nt, artificial
  Completely synthesized
uguaacucaggaauggaua

SEQ ID NO: 2431 - RNA, 19 nt, artificial
  Completely synthesized
ugcuguugcugauacuggg

SEQ ID NO: 2432 - RNA, 19 nt, artificial
  Completely synthesized
uaaugaguucacugucaac

SEQ ID NO: 2433 - RNA, 19 nt, artificial
  Completely synthesized
uuaagacacuguaacucag

SEQ ID NO: 2434 - RNA, 19 nt, artificial
  Completely synthesized
auaucuugccuccaaagua

SEQ ID NO: 2435 - RNA, 19 nt, artificial
  Completely synthesized
aguuucaggugacugagcc

SEQ ID NO: 2436 - RNA, 19 nt, artificial
  Completely synthesized
aucaaaguacaaagcaucu

SEQ ID NO: 2437 - RNA, 19 nt, artificial
  Completely synthesized
uuagccagaugucauauca

SEQ ID NO: 2438 - RNA, 19 nt, artificial
  Completely synthesized
aguauuuacacuuacacag

SEQ ID NO: 2439 - RNA, 19 nt, artificial
  Completely synthesized
acauacugacacuccaaug

SEQ ID NO: 2440 - RNA, 19 nt, artificial
  Completely synthesized
aucuggcuucuuacuuuug

SEQ ID NO: 2441 - RNA, 19 nt, artificial
  Completely synthesized
aggcuuuugucauuuucuc

SEQ ID NO: 2442 - RNA, 19 nt, artificial
  Completely synthesized
cuugucuuuccuuuucaag

SEQ ID NO: 2443 - RNA, 19 nt, artificial
  Completely synthesized
uaucccgaauuaaugcaag

SEQ ID NO: 2444 - RNA, 19 nt, artificial
  Completely synthesized
cucuuuggacaucauuucg

SEQ ID NO: 2445 - RNA, 19 nt, artificial
  Completely synthesized
guugaagucaacaacaggg

SEQ ID NO: 2446 - RNA, 19 nt, artificial
  Completely synthesized
ugggauauggagagcuuuu

SEQ ID NO: 2447 - RNA, 19 nt, artificial
  Completely synthesized
auagcuggaagauuccacu

SEQ ID NO: 2448 - RNA, 19 nt, artificial
  Completely synthesized
uggaagauuccacugagug

SEQ ID NO: 2449 - RNA, 19 nt, artificial
  Completely synthesized
gccggagucagaaucauug

SEQ ID NO: 2450 - RNA, 19 nt, artificial
  Completely synthesized
aucaaugggcccauuuaga

SEQ ID NO: 2451 - RNA, 19 nt, artificial
  Completely synthesized
guucacugucaacugguug

SEQ ID NO: 2452 - RNA, 19 nt, artificial
  Completely synthesized
aagaucuauaucuugccuc

SEQ ID NO: 2453 - RNA, 19 nt, artificial
  Completely synthesized
uucaggugacugagccuga

SEQ ID NO: 2454 - RNA, 19 nt, artificial
  Completely synthesized
cugauuaguagcaaugaag

SEQ ID NO: 2455 - RNA, 19 nt, artificial
  Completely synthesized
ugaauugggagaaauucac

SEQ ID NO: 2456 - RNA, 19 nt, artificial
  Completely synthesized
ucaucuaguuguaacugag

SEQ ID NO: 2457 - RNA, 19 nt, artificial
  Completely synthesized
aacaucuggcuucuuacuu

SEQ ID NO: 2458 - RNA, 19 nt, artificial
  Completely synthesized
uuugggaacaaggaaaaca

SEQ ID NO: 2459 - RNA, 19 nt, artificial
  Completely synthesized
aucucuuguuugcugcagg

SEQ ID NO: 2460 - RNA, 19 nt, artificial
  Completely synthesized
aagguuuuccaucuucauc

SEQ ID NO: 2461 - RNA, 19 nt, artificial
  Completely synthesized
aaucuugcucuaguucuac

SEQ ID NO: 2462 - RNA, 19 nt, artificial
  Completely synthesized
uccauugaggguauagaug

SEQ ID NO: 2463 - RNA, 19 nt, artificial
  Completely synthesized
uuguaacugagcgaaaaag

SEQ ID NO: 2464 - RNA, 19 nt, artificial
  Completely synthesized
uucucuugcuccuuuugga

SEQ ID NO: 2465 - RNA, 19 nt, artificial
  Completely synthesized
aaggaaaacauugccaucu

SEQ ID NO: 2466 - RNA, 19 nt, artificial
  Completely synthesized
uauaaggugcugaguuguu

SEQ ID NO: 2467 - RNA, 19 nt, artificial
  Completely synthesized
gcucauacucuuuccgucg

SEQ ID NO: 2468 - RNA, 19 nt, artificial
  Completely synthesized
ugguguguucucacauugg

SEQ ID NO: 2469 - RNA, 19 nt, artificial
  Completely synthesized
agugaauggcuuaaaguag

SEQ ID NO: 2470 - RNA, 19 nt, artificial
  Completely synthesized
cucccaaacuugcucaaug

SEQ ID NO: 2471 - RNA, 19 nt, artificial
  Completely synthesized
guugcauaccgucuaaauc

SEQ ID NO: 2472 - RNA, 19 nt, artificial
  Completely synthesized
aucuugccuccaaaguaug

SEQ ID NO: 2473 - RNA, 19 nt, artificial
  Completely synthesized
ugauuaguagcaaugaaga

SEQ ID NO: 2474 - RNA, 19 nt, artificial
  Completely synthesized
cuacugauucaacauacug

SEQ ID NO: 2475 - RNA, 19 nt, artificial
  Completely synthesized
auacugacacuccaaugcu

SEQ ID NO: 2476 - RNA, 19 nt, artificial
  Completely synthesized
acugacacuccaaugcuuu

SEQ ID NO: 2477 - RNA, 19 nt, artificial
  Completely synthesized
ucucuuguuugcugcaggg

SEQ ID NO: 2478 - RNA, 19 nt, artificial
  Completely synthesized
auauaaggugcugaguugu

SEQ ID NO: 2479 - RNA, 19 nt, artificial
  Completely synthesized
aucuugcucuaguucuacu

SEQ ID NO: 2480 - RNA, 19 nt, artificial
  Completely synthesized
ugcaauucugagcagccac

SEQ ID NO: 2481 - RNA, 19 nt, artificial
  Completely synthesized
cuguuuuuccagcucauac

SEQ ID NO: 2482 - RNA, 19 nt, artificial
  Completely synthesized
agugaaaugccggagucag

SEQ ID NO: 2483 - RNA, 19 nt, artificial
  Completely synthesized
aaguccaucaugaugagcu

SEQ ID NO: 2484 - RNA, 19 nt, artificial
  Completely synthesized
ucagaaucauugaauucug

SEQ ID NO: 2485 - RNA, 19 nt, artificial
  Completely synthesized
aaagugauagaucagaaac

SEQ ID NO: 2486 - RNA, 19 nt, artificial
  Completely synthesized
uugcugauacugggcucag

SEQ ID NO: 2487 - RNA, 19 nt, artificial
  Completely synthesized
uggcaucugaauuuaauga

SEQ ID NO: 2488 - RNA, 19 nt, artificial
  Completely synthesized
agaucuauaucuugccucc

SEQ ID NO: 2489 - RNA, 19 nt, artificial
  Completely synthesized
agccugauuaguagcaaug

SEQ ID NO: 2490 - RNA, 19 nt, artificial
  Completely synthesized
uagcaaugaagacugggcu

SEQ ID NO: 2491 - RNA, 19 nt, artificial
  Completely synthesized
uaucaggaacaagugacug

SEQ ID NO: 2492 - RNA, 19 nt, artificial
  Completely synthesized
ucucuugcuccuuuuggag

SEQ ID NO: 2493 - RNA, 19 nt, artificial
  Completely synthesized
uuacuuuugggaacaagga

SEQ ID NO: 2494 - RNA, 19 nt, artificial
  Completely synthesized
uuuucaguaggugaaggcu

SEQ ID NO: 2495 - RNA, 19 nt, artificial
  Completely synthesized
uaggugaaggcuuuuguca

SEQ ID NO: 2496 - RNA, 19 nt, artificial
  Completely synthesized
gaaggcuuuugucauuuuc

SEQ ID NO: 2497 - RNA, 19 nt, artificial
  Completely synthesized
uaaugcaaguugagcuuca

SEQ ID NO: 2498 - RNA, 19 nt, artificial
  Completely synthesized
uucaucucuugugagauga

SEQ ID NO: 2499 - RNA, 19 nt, artificial
  Completely synthesized
aucacugaggccaaguagu

SEQ ID NO: 2500 - RNA, 19 nt, artificial
  Completely synthesized
uagcuggaagauuccacug

SEQ ID NO: 2501 - RNA, 19 nt, artificial
  Completely synthesized
acugaagucaaauacuucu

SEQ ID NO: 2502 - RNA, 19 nt, artificial
  Completely synthesized
uguggcaucugaauuuaau

SEQ ID NO: 2503 - RNA, 19 nt, artificial
  Completely synthesized
ugaaggaauccucaaaagc

SEQ ID NO: 2504 - RNA, 19 nt, artificial
  Completely synthesized
guggacuacaguuaccuac

SEQ ID NO: 2505 - RNA, 19 nt, artificial
  Completely synthesized
ucaauguccuguugcauac

SEQ ID NO: 2506 - RNA, 19 nt, artificial
  Completely synthesized
ucuugccuccaaaguaugu

SEQ ID NO: 2507 - RNA, 19 nt, artificial
  Completely synthesized
augugaccgggaauaucag

SEQ ID NO: 2508 - RNA, 19 nt, artificial
  Completely synthesized
acugguuucugacuggaug

SEQ ID NO: 2509 - RNA, 19 nt, artificial
  Completely synthesized
ucacguagcaugcugaaaa

SEQ ID NO: 2510 - RNA, 19 nt, artificial
  Completely synthesized
cuccaaguccaucaugaug

SEQ ID NO: 2511 - RNA, 19 nt, artificial
  Completely synthesized
auggugacaaggguuguac

SEQ ID NO: 2512 - RNA, 19 nt, artificial
  Completely synthesized
ucugcugugcuuucagggu

SEQ ID NO: 2513 - RNA, 19 nt, artificial
  Completely synthesized
uucagagagugaauggcuu

SEQ ID NO: 2514 - RNA, 19 nt, artificial
  Completely synthesized
ugauacugggcucagcuau

SEQ ID NO: 2515 - RNA, 19 nt, artificial
  Completely synthesized
ucuguguugacuguggcau

SEQ ID NO: 2516 - RNA, 19 nt, artificial
  Completely synthesized
uugucaacuucugucaguu

SEQ ID NO: 2517 - RNA, 19 nt, artificial
  Completely synthesized
agucucaaccagcuuguca

SEQ ID NO: 2518 - RNA, 19 nt, artificial
  Completely synthesized
aguagcaaugaagacuggg

SEQ ID NO: 2519 - RNA, 19 nt, artificial
  Completely synthesized
aagacugggcucucgaugu

SEQ ID NO: 2520 - RNA, 19 nt, artificial
  Completely synthesized
uaguuggcagauccacugg

SEQ ID NO: 2521 - RNA, 19 nt, artificial
  Completely synthesized
uuaguaccagcucuuaaaa

SEQ ID NO: 2522 - RNA, 19 nt, artificial
  Completely synthesized
cguauaucccgaauuaaug

SEQ ID NO: 2523 - RNA, 19 nt, artificial
  Completely synthesized
uccgaugaccaggacuuac

SEQ ID NO: 2524 - RNA, 19 nt, artificial
  Completely synthesized
uguguucucacauugggca

SEQ ID NO: 2525 - RNA, 19 nt, artificial
  Completely synthesized
caaggguuguaccauaucc

SEQ ID NO: 2526 - RNA, 19 nt, artificial
  Completely synthesized
uccauagcuggaagauucc

SEQ ID NO: 2527 - RNA, 19 nt, artificial
  Completely synthesized
ugccggagucagaaucauu

SEQ ID NO: 2528 - RNA, 19 nt, artificial
  Completely synthesized
auucugcugugcuuucagg

SEQ ID NO: 2529 - RNA, 19 nt, artificial
  Completely synthesized
cucgacuuacuccaagauc

SEQ ID NO: 2530 - RNA, 19 nt, artificial
  Completely synthesized
acuucuuuuuccauugagg

SEQ ID NO: 2531 - RNA, 19 nt, artificial
  Completely synthesized
cuucuuuuuccauugaggg

SEQ ID NO: 2532 - RNA, 19 nt, artificial
  Completely synthesized
uucuuuuuccauugagggu

SEQ ID NO: 2533 - RNA, 19 nt, artificial
  Completely synthesized
uagccgaagaaaccucauu

SEQ ID NO: 2534 - RNA, 19 nt, artificial
  Completely synthesized
aaaagcugcaugcagucau

SEQ ID NO: 2535 - RNA, 19 nt, artificial
  Completely synthesized
uucaucuaguuguaacuga

SEQ ID NO: 2536 - RNA, 19 nt, artificial
  Completely synthesized
ugguguccuaagaaauugu

SEQ ID NO: 2537 - RNA, 19 nt, artificial
  Completely synthesized
ucagaaaaggucaaauccu

SEQ ID NO: 2538 - RNA, 19 nt, artificial
  Completely synthesized
uucaguaggugaaggcuuu

SEQ ID NO: 2539 - RNA, 19 nt, artificial
  Completely synthesized
ggcuuuugucauuuucucc

SEQ ID NO: 2540 - RNA, 19 nt, artificial
  Completely synthesized
uuccgucgcugacugaagu

SEQ ID NO: 2541 - RNA, 19 nt, artificial
  Completely synthesized
acugaggccaaguagugug

SEQ ID NO: 2542 - RNA, 19 nt, artificial
  Completely synthesized
uucugucaguuuggcuucu

SEQ ID NO: 2543 - RNA, 19 nt, artificial
  Completely synthesized
aauguccuguugcauaccg

SEQ ID NO: 2544 - RNA, 19 nt, artificial
  Completely synthesized
uguugcauaccgucuaaau

SEQ ID NO: 2545 - RNA, 19 nt, artificial
  Completely synthesized
accgucuaaaucaacaggg

SEQ ID NO: 2546 - RNA, 19 nt, artificial
  Completely synthesized
uaccugagcaacagaaguu

SEQ ID NO: 2547 - RNA, 19 nt, artificial
  Completely synthesized
uaacugagcgaaaaaggcu

SEQ ID NO: 2548 - RNA, 19 nt, artificial
  Completely synthesized
cuuuuuagccagaugucau

SEQ ID NO: 2549 - RNA, 19 nt, artificial
  Completely synthesized
guaguauuuacacuuacac

SEQ ID NO: 2550 - RNA, 19 nt, artificial
  Completely synthesized
acuaguuuuggcuaugauu

SEQ ID NO: 2551 - RNA, 19 nt, artificial
  Completely synthesized
uugcuccuuuuggaguugu

SEQ ID NO: 2552 - RNA, 19 nt, artificial
  Completely synthesized
ugcugcagggaguauucac

SEQ ID NO: 2553 - RNA, 19 nt, artificial
  Completely synthesized
gugaaggcuuuugucauuu

SEQ ID NO: 2554 - RNA, 19 nt, artificial
  Completely synthesized
guauaucccgaauuaaugc

SEQ ID NO: 2555 - RNA, 19 nt, artificial
  Completely synthesized
augggauauggagagcuuu

SEQ ID NO: 2556 - RNA, 19 nt, artificial
  Completely synthesized
ucucuugugagaugagccu

SEQ ID NO: 2557 - RNA, 19 nt, artificial
  Completely synthesized
agugugucuccauagcugg

SEQ ID NO: 2558 - RNA, 19 nt, artificial
  Completely synthesized
cuucucgacuuacuccaag

SEQ ID NO: 2559 - RNA, 19 nt, artificial
  Completely synthesized
cagaauaaaauucaucacc

SEQ ID NO: 2560 - RNA, 19 nt, artificial
  Completely synthesized
aauucaucaccaaaaucug

SEQ ID NO: 2561 - RNA, 19 nt, Artificial
  Completely synthesized
ugauaauugucaacuucug

SEQ ID NO: 2562 - RNA, 21 nt, artificial
  Completely synthesized
ugcagaaaaagaaaacuggaa

SEQ ID NO: 2563 - RNA, 21 nt, artificial
  Completely synthesized
gaaagaguaugagcuggaaaa

SEQ ID NO: 2564 - RNA, 21 nt, artificial
  Completely synthesized
gaauaaaguggcugcucagaa

SEQ ID NO: 2565 - RNA, 21 nt, artificial
  Completely synthesized
guaugagcuggaaaaacagaa

SEQ ID NO: 2566 - RNA, 21 nt, artificial
  Completely synthesized
gcuacgugaugaagauggaaa

SEQ ID NO: 2567 - RNA, 21 nt, artificial
  Completely synthesized
cagugauucugaaguggaaga

SEQ ID NO: 2568 - RNA, 21 nt, artificial
  Completely synthesized
cgugcaugaugcccaauguga

SEQ ID NO: 2569 - RNA, 21 nt, artificial
  Completely synthesized
ucaaccaaaaccacccugaaa

SEQ ID NO: 2570 - RNA, 21 nt, artificial
  Completely synthesized
aguugacagugaacucauuaa

SEQ ID NO: 2571 - RNA, 21 nt, artificial
  Completely synthesized
gaaaaggaaagacaagaacaa

SEQ ID NO: 2572 - RNA, 21 nt, artificial
  Completely synthesized
ggagaaaaugacaaaagccuu

SEQ ID NO: 2573 - RNA, 21 nt, artificial
  Completely synthesized
caucgagagcccagucuucau

SEQ ID NO: 2574 - RNA, 21 nt, artificial
  Completely synthesized
auugcaaaacuaaccacuaug

SEQ ID NO: 2575 - RNA, 21 nt, artificial
  Completely synthesized
gcaugaugcccaaugugagaa

SEQ ID NO: 2576 - RNA, 21 nt, artificial
  Completely synthesized
caaccaaaaccacccugaaag

SEQ ID NO: 2577 - RNA, 21 nt, artificial
  Completely synthesized
ugaugaagauggaaaaccuua

SEQ ID NO: 2578 - RNA, 21 nt, artificial
  Completely synthesized
cauuaauucgggauauacgua

SEQ ID NO: 2579 - RNA, 21 nt, artificial
  Completely synthesized
ccucccuguuguugacuucaa

SEQ ID NO: 2580 - RNA, 21 nt, artificial
  Completely synthesized
gcuuggaggcucaucucacaa

SEQ ID NO: 2581 - RNA, 21 nt, artificial
  Completely synthesized
cccuggaagugucaaacagaa

SEQ ID NO: 2582 - RNA, 21 nt, artificial
  Completely synthesized
cuuucauagcugagcccagua

SEQ ID NO: 2583 - RNA, 21 nt, artificial
  Completely synthesized
gguuccaaguccagaagccaa

SEQ ID NO: 2584 - RNA, 21 nt, artificial
  Completely synthesized
gcaaguuugggaggagcuauu

SEQ ID NO: 2585 - RNA, 21 nt, artificial
  Completely synthesized
guaaguccuggucaucggaaa

SEQ ID NO: 2586 - RNA, 21 nt, artificial
  Completely synthesized
caguguggcaucaccagaaca

SEQ ID NO: 2587 - RNA, 21 nt, artificial
  Completely synthesized
gauucugacuccggcauuuca

SEQ ID NO: 2588 - RNA, 21 nt, artificial
  Completely synthesized
guuccaaguccagaagccaaa

SEQ ID NO: 2589 - RNA, 21 nt, artificial
  Completely synthesized
cgcucaguuacaacuagauga

SEQ ID NO: 2590 - RNA, 21 nt, artificial
  Completely synthesized
ugauuuagacgguaugcaaca

SEQ ID NO: 2591 - RNA, 21 nt, artificial
  Completely synthesized
gcuaguuucuguguaagugua

SEQ ID NO: 2592 - RNA, 21 nt, artificial
  Completely synthesized
cuaugcaaaaucauagccaaa

SEQ ID NO: 2593 - RNA, 21 nt, artificial
  Completely synthesized
cuguuguugacuucaacgaaa

SEQ ID NO: 2594 - RNA, 21 nt, artificial
  Completely synthesized
uaagaagccagauguuaagaa

SEQ ID NO: 2595 - RNA, 21 nt, artificial
  Completely synthesized
cauuaaccucccuguuguuga

SEQ ID NO: 2596 - RNA, 21 nt, artificial
  Completely synthesized
aagagaugaacuuagggcaaa

SEQ ID NO: 2597 - RNA, 21 nt, artificial
  Completely synthesized
cacccugaaagcacagcagaa

SEQ ID NO: 2598 - RNA, 21 nt, artificial
  Completely synthesized
caucuauacccucaauggaaa

SEQ ID NO: 2599 - RNA, 21 nt, artificial
  Completely synthesized
cgguaugcaacaggacauuga

SEQ ID NO: 2600 - RNA, 21 nt, artificial
  Completely synthesized
agcuccuacugugaugugaaa

SEQ ID NO: 2601 - RNA, 21 nt, artificial
  Completely synthesized
uguuguugacuucaacgaaau

SEQ ID NO: 2602 - RNA, 21 nt, artificial
  Completely synthesized
cuuggaguaagucgagaagua

SEQ ID NO: 2603 - RNA, 21 nt, artificial
  Completely synthesized
caaacugacagaaguugacaa

SEQ ID NO: 2604 - RNA, 21 nt, artificial
  Completely synthesized
cccagcacauccagucagaaa

SEQ ID NO: 2605 - RNA, 21 nt, artificial
  Completely synthesized
cagcaaacaagagauggcaau

SEQ ID NO: 2606 - RNA, 21 nt, artificial
  Completely synthesized
agcugagcccaguaucagcaa

SEQ ID NO: 2607 - RNA, 21 nt, artificial
  Completely synthesized
auacuuuggaggcaagauaua

SEQ ID NO: 2608 - RNA, 21 nt, artificial
  Completely synthesized
uaagaauaaaguggcugcuca

SEQ ID NO: 2609 - RNA, 21 nt, artificial
  Completely synthesized
gauguccaaagagcaguucaa

SEQ ID NO: 2610 - RNA, 21 nt, artificial
  Completely synthesized
caaugauucugacuccggcau

SEQ ID NO: 2611 - RNA, 21 nt, artificial
  Completely synthesized
guagguaacuguaguccacau

SEQ ID NO: 2612 - RNA, 21 nt, artificial
  Completely synthesized
auacccucaauggaaaaagaa

SEQ ID NO: 2613 - RNA, 21 nt, artificial
  Completely synthesized
aggcaagauauagaucuugga

SEQ ID NO: 2614 - RNA, 21 nt, artificial
  Completely synthesized
gaugauaugacaucuggcuaa

SEQ ID NO: 2615 - RNA, 21 nt, artificial
  Completely synthesized
cuccaaaaggagcaagagaaa

SEQ ID NO: 2616 - RNA, 21 nt, artificial
  Completely synthesized
cuugcauuaauucgggauaua

SEQ ID NO: 2617 - RNA, 21 nt, artificial
  Completely synthesized
gcucaucucacaagagaugaa

SEQ ID NO: 2618 - RNA, 21 nt, artificial
  Completely synthesized
ggaggcucaucucacaagaga

SEQ ID NO: 2619 - RNA, 21 nt, artificial
  Completely synthesized
ccucagugauucugaagugga

SEQ ID NO: 2620 - RNA, 21 nt, artificial
  Completely synthesized
cagguugcccacauucccaaa

SEQ ID NO: 2621 - RNA, 21 nt, artificial
  Completely synthesized
caauguuuuccuuguucccaa

SEQ ID NO: 2622 - RNA, 21 nt, artificial
  Completely synthesized
gcuggaaaaacagaaaaaacu

SEQ ID NO: 2623 - RNA, 21 nt, artificial
  Completely synthesized
cccuguuguugacuucaacga

SEQ ID NO: 2624 - RNA, 21 nt, artificial
  Completely synthesized
uuugcaaagcuuucaaccaaa

SEQ ID NO: 2625 - RNA, 21 nt, artificial
  Completely synthesized
aaauucagaugccacagucaa

SEQ ID NO: 2626 - RNA, 21 nt, artificial
  Completely synthesized
gguuucuucggcuacguuuca

SEQ ID NO: 2627 - RNA, 21 nt, artificial
  Completely synthesized
gcagcuuuuggcgcagacauu

SEQ ID NO: 2628 - RNA, 21 nt, artificial
  Completely synthesized
acuagaugaagagacagguga

SEQ ID NO: 2629 - RNA, 21 nt, artificial
  Completely synthesized
ugauaugacaucuggcuaaaa

SEQ ID NO: 2630 - RNA, 21 nt, artificial
  Completely synthesized
caaaagccuucaccuacugaa

SEQ ID NO: 2631 - RNA, 21 nt, artificial
  Completely synthesized
agaaaaugacaaaagccuuca

SEQ ID NO: 2632 - RNA, 21 nt, artificial
  Completely synthesized
gcauuaauucgggauauacgu

SEQ ID NO: 2633 - RNA, 21 nt, artificial
  Completely synthesized
uugcaaagcuuucaaccaaaa

SEQ ID NO: 2634 - RNA, 21 nt, artificial
  Completely synthesized
ccaguugacagugaacucauu

SEQ ID NO: 2635 - RNA, 21 nt, artificial
  Completely synthesized
cagcauccucuccacagaaga

SEQ ID NO: 2636 - RNA, 21 nt, artificial
  Completely synthesized
ccuuauaucucgaaguuuuca

SEQ ID NO: 2637 - RNA, 21 nt, artificial
  Completely synthesized
ccuguuguugacuucaacgaa

SEQ ID NO: 2638 - RNA, 21 nt, artificial
  Completely synthesized
cauugauguuucugaucuauc

SEQ ID NO: 2639 - RNA, 21 nt, artificial
  Completely synthesized
aguaagucgagaaguauuuga

SEQ ID NO: 2640 - RNA, 21 nt, artificial
  Completely synthesized
agaucuuggaguaagucgaga

SEQ ID NO: 2641 - RNA, 21 nt, artificial
  Completely synthesized
gaaguagguaacuguagucca

SEQ ID NO: 2642 - RNA, 21 nt, artificial
  Completely synthesized
cuuuguacuuugaugacugca

SEQ ID NO: 2643 - RNA, 21 nt, artificial
  Completely synthesized
gaugaagagacaggugaauuu

SEQ ID NO: 2644 - RNA, 21 nt, artificial
  Completely synthesized
caaaacuaaccacuauguacu

SEQ ID NO: 2645 - RNA, 21 nt, artificial
  Completely synthesized
uuuccuuguucccaaaaguaa

SEQ ID NO: 2646 - RNA, 21 nt, artificial
  Completely synthesized
ggaaagacaagaacaacucca

SEQ ID NO: 2647 - RNA, 21 nt, artificial
  Completely synthesized
uauaguagaacuagagcaaga

SEQ ID NO: 2648 - RNA, 21 nt, artificial
  Completely synthesized
cccugaaagcacagcagaauu

SEQ ID NO: 2649 - RNA, 21 nt, artificial
  Completely synthesized
ucauuaaauucagaugccaca

SEQ ID NO: 2650 - RNA, 21 nt, artificial
  Completely synthesized
cagaaaccaguggaucugcca

SEQ ID NO: 2651 - RNA, 21 nt, artificial
  Completely synthesized
ugaagagacaggugaauuucu

SEQ ID NO: 2652 - RNA, 21 nt, artificial
  Completely synthesized
ccuuguucccaaaaguaagaa

SEQ ID NO: 2653 - RNA, 21 nt, artificial
  Completely synthesized
aauacucccugcagcaaacaa

SEQ ID NO: 2654 - RNA, 21 nt, artificial
  Completely synthesized
gaauacucccugcagcaaaca

SEQ ID NO: 2655 - RNA, 21 nt, artificial
  Completely synthesized
ccuucaccuacugaaaaaaca

SEQ ID NO: 2656 - RNA, 21 nt, artificial
  Completely synthesized
uucugaaguggaagagcuaga

SEQ ID NO: 2657 - RNA, 21 nt, artificial
  Completely synthesized
cucagugauucugaaguggaa

SEQ ID NO: 2658 - RNA, 21 nt, artificial
  Completely synthesized
ucugaucuaucacuuugcaaa

SEQ ID NO: 2659 - RNA, 21 nt, artificial
  Completely synthesized
cauucccguuuguagaugaca

SEQ ID NO: 2660 - RNA, 21 nt, artificial
  Completely synthesized
acuccaaaaggagcaagagaa

SEQ ID NO: 2661 - RNA, 21 nt, artificial
  Completely synthesized
caaugaagcucaacuugcauu

SEQ ID NO: 2662 - RNA, 21 nt, artificial
  Completely synthesized
ugugagaacacaccagagaaa

SEQ ID NO: 2663 - RNA, 21 nt, artificial
  Completely synthesized
caaacagaaugguccuaaaac

SEQ ID NO: 2664 - RNA, 21 nt, artificial
  Completely synthesized
ugucaaacagaaugguccuaa

SEQ ID NO: 2665 - RNA, 21 nt, artificial
  Completely synthesized
ugaaagcacagcagaauucaa

SEQ ID NO: 2666 - RNA, 21 nt, artificial
  Completely synthesized
ggugaugaauuuuauucugcu

SEQ ID NO: 2667 - RNA, 21 nt, artificial
  Completely synthesized
aucuauacccucaauggaaaa

SEQ ID NO: 2668 - RNA, 21 nt, artificial
  Completely synthesized
caaugagguuucuucggcuac

SEQ ID NO: 2669 - RNA, 21 nt, artificial
  Completely synthesized
acuagauuuaggaggauuuga

SEQ ID NO: 2670 - RNA, 21 nt, artificial
  Completely synthesized
gaugaagauggaaaaccuuau

SEQ ID NO: 2671 - RNA, 21 nt, artificial
  Completely synthesized
aggagaaaaugacaaaagccu

SEQ ID NO: 2672 - RNA, 21 nt, artificial
  Completely synthesized
gaggcucaucucacaagagau

SEQ ID NO: 2673 - RNA, 21 nt, artificial
  Completely synthesized
uguaaguccuggucaucggaa

SEQ ID NO: 2674 - RNA, 21 nt, artificial
  Completely synthesized
caaaaccacccugaaagcaca

SEQ ID NO: 2675 - RNA, 21 nt, artificial
  Completely synthesized
accaaaaccacccugaaagca

SEQ ID NO: 2676 - RNA, 21 nt, artificial
  Completely synthesized
acuucuaaaugggcccauuga

SEQ ID NO: 2677 - RNA, 21 nt, artificial
  Completely synthesized
cacagauuuuggugaugaauu

SEQ ID NO: 2678 - RNA, 21 nt, artificial
  Completely synthesized
gauauagaucuuggaguaagu

SEQ ID NO: 2679 - RNA, 21 nt, artificial
  Completely synthesized
acuuuggaggcaagauauaga

SEQ ID NO: 2680 - RNA, 21 nt, artificial
  Completely synthesized
cuucuaaaugggcccauugau

SEQ ID NO: 2681 - RNA, 21 nt, artificial
  Completely synthesized
cauucacucucugaacuucua

SEQ ID NO: 2682 - RNA, 21 nt, artificial
  Completely synthesized
agaugccacagucaacacaga

SEQ ID NO: 2683 - RNA, 21 nt, artificial
  Completely synthesized
agcagcauccucuccacagaa

SEQ ID NO: 2684 - RNA, 21 nt, artificial
  Completely synthesized
gacagaaguugacaauuauca

SEQ ID NO: 2685 - RNA, 21 nt, artificial
  Completely synthesized
cugacagaaguugacaauuau

SEQ ID NO: 2686 - RNA, 21 nt, artificial
  Completely synthesized
cauugagcaaguuugggagga

SEQ ID NO: 2687 - RNA, 21 nt, artificial
  Completely synthesized
ugauauucccggucacaucga

SEQ ID NO: 2688 - RNA, 21 nt, artificial
  Completely synthesized
cagacauucccguuuguagau

SEQ ID NO: 2689 - RNA, 21 nt, artificial
  Completely synthesized
ccagcaggacauggauuugau

SEQ ID NO: 2690 - RNA, 21 nt, artificial
  Completely synthesized
caauuucuuaggacaccauuu

SEQ ID NO: 2691 - RNA, 21 nt, artificial
  Completely synthesized
acuaaaagcuccuacugugau

SEQ ID NO: 2692 - RNA, 21 nt, artificial
  Completely synthesized
cuugaaaaggaaagacaagaa

SEQ ID NO: 2693 - RNA, 21 nt, artificial
  Completely synthesized
acuagagcaagauuuagauca

SEQ ID NO: 2694 - RNA, 21 nt, artificial
  Completely synthesized
cauaucccauucccuguagaa

SEQ ID NO: 2695 - RNA, 21 nt, artificial
  Completely synthesized
caaaagcucuccauaucccau

SEQ ID NO: 2696 - RNA, 21 nt, artificial
  Completely synthesized
cuguaaguccuggucaucgga

SEQ ID NO: 2697 - RNA, 21 nt, artificial
  Completely synthesized
gugucaaacagaaugguccua

SEQ ID NO: 2698 - RNA, 21 nt, artificial
  Completely synthesized
uuucaaccaaaaccacccuga

SEQ ID NO: 2699 - RNA, 21 nt, artificial
  Completely synthesized
ugauguuucugaucuaucacu

SEQ ID NO: 2700 - RNA, 21 nt, artificial
  Completely synthesized
cccucaauggaaaaagaagua

SEQ ID NO: 2701 - RNA, 21 nt, artificial
  Completely synthesized
uuuacucaucuauacccucaa

SEQ ID NO: 2702 - RNA, 21 nt, artificial
  Completely synthesized
ccagaagccaaacugacagaa

SEQ ID NO: 2703 - RNA, 21 nt, artificial
  Completely synthesized
aguccagaagccaaacugaca

SEQ ID NO: 2704 - RNA, 21 nt, artificial
  Completely synthesized
ccugaguuacagugucuuaau

SEQ ID NO: 2705 - RNA, 21 nt, artificial
  Completely synthesized
cauugcuacuaaucaggcuca

SEQ ID NO: 2706 - RNA, 21 nt, artificial
  Completely synthesized
ggauuugauugacauacuuug

SEQ ID NO: 2707 - RNA, 21 nt, artificial
  Completely synthesized
cgguccacagcucaucaugau

SEQ ID NO: 2708 - RNA, 21 nt, artificial
  Completely synthesized
ggugaauuucucccaauucag

SEQ ID NO: 2709 - RNA, 21 nt, artificial
  Completely synthesized
aaaguaagaagccagauguua

SEQ ID NO: 2710 - RNA, 21 nt, artificial
  Completely synthesized
gagaaaaugacaaaagccuuc

SEQ ID NO: 2711 - RNA, 21 nt, artificial
  Completely synthesized
aguagaacuagagcaagauuu

SEQ ID NO: 2712 - RNA, 21 nt, artificial
  Completely synthesized
agaauaaaguggcugcucaga

SEQ ID NO: 2713 - RNA, 21 nt, artificial
  Completely synthesized
uaucccauucccuguagaaaa

SEQ ID NO: 2714 - RNA, 21 nt, artificial
  Completely synthesized
ccaaugugagaacacaccaga

SEQ ID NO: 2715 - RNA, 21 nt, artificial
  Completely synthesized
ucaccagaacacucaguggaa

SEQ ID NO: 2716 - RNA, 21 nt, artificial
  Completely synthesized
guggcaucaccagaacacuca

SEQ ID NO: 2717 - RNA, 21 nt, artificial
  Completely synthesized
cuuugcaaagcuuucaaccaa

SEQ ID NO: 2718 - RNA, 21 nt, artificial
  Completely synthesized
uucacucucugaacuucuaaa

SEQ ID NO: 2719 - RNA, 21 nt, artificial
  Completely synthesized
caauggaaaaagaaguaggua

SEQ ID NO: 2720 - RNA, 21 nt, artificial
  Completely synthesized
caagcugguugagacuaccau

SEQ ID NO: 2721 - RNA, 21 nt, artificial
  Completely synthesized
acauacuuuggaggcaagaua

SEQ ID NO: 2722 - RNA, 21 nt, artificial
  Completely synthesized
aguaugagcuggaaaaacaga

SEQ ID NO: 2723 - RNA, 21 nt, artificial
  Completely synthesized
aacacacgguccacagcucau

SEQ ID NO: 2724 - RNA, 21 nt, artificial
  Completely synthesized
gcccaaugugagaacacacca

SEQ ID NO: 2725 - RNA, 21 nt, artificial
  Completely synthesized
cagaaugguccuaaaacacca

SEQ ID NO: 2726 - RNA, 21 nt, artificial
  Completely synthesized
cacacuacuuggccucaguga

SEQ ID NO: 2727 - RNA, 21 nt, artificial
  Completely synthesized
guggaaucuuccagcuaugga

SEQ ID NO: 2728 - RNA, 21 nt, artificial
  Completely synthesized
ccaaaaccacccugaaagcac

SEQ ID NO: 2729 - RNA, 21 nt, artificial
  Completely synthesized
gaugccacagucaacacagau

SEQ ID NO: 2730 - RNA, 21 nt, artificial
  Completely synthesized
cgcagacauucccguuuguag

SEQ ID NO: 2731 - RNA, 21 nt, artificial
  Completely synthesized
agaaaccaguggaucugccaa

SEQ ID NO: 2732 - RNA, 21 nt, artificial
  Completely synthesized
cugaguuacagugucuuaaua

SEQ ID NO: 2733 - RNA, 21 nt, artificial
  Completely synthesized
cuuugaugacugcaugcagcu

SEQ ID NO: 2734 - RNA, 21 nt, artificial
  Completely synthesized
cucgaaguuuucagcaugcua

SEQ ID NO: 2735 - RNA, 21 nt, artificial
  Completely synthesized
cuucaacgaaaugauguccaa

SEQ ID NO: 2736 - RNA, 21 nt, artificial
  Completely synthesized
augugagaacacaccagagaa

SEQ ID NO: 2737 - RNA, 21 nt, artificial
  Completely synthesized
gagacuaccaugguuccaagu

SEQ ID NO: 2738 - RNA, 21 nt, artificial
  Completely synthesized
uccugaguuacagugucuuaa

SEQ ID NO: 2739 - RNA, 21 nt, artificial
  Completely synthesized
gagcaaguuugggaggagcua

SEQ ID NO: 2740 - RNA, 21 nt, artificial
  Completely synthesized
cauacuuuggaggcaagauau

SEQ ID NO: 2741 - RNA, 21 nt, artificial
  Completely synthesized
acaucgagagcccagucuuca

SEQ ID NO: 2742 - RNA, 21 nt, artificial
  Completely synthesized
cguuuguagaugacaaugagg

SEQ ID NO: 2743 - RNA, 21 nt, artificial
  Completely synthesized
cauucccaaaucagaugcuuu

SEQ ID NO: 2744 - RNA, 21 nt, artificial
  Completely synthesized
aggugaauuucucccaauuca

SEQ ID NO: 2745 - RNA, 21 nt, artificial
  Completely synthesized
gccuuuuucgcucaguuacaa

SEQ ID NO: 2746 - RNA, 21 nt, artificial
  Completely synthesized
aaaggagcaagagaaagccuu

SEQ ID NO: 2747 - RNA, 21 nt, artificial
  Completely synthesized
cuuaggacaccauuugggcua

SEQ ID NO: 2748 - RNA, 21 nt, artificial
  Completely synthesized
cauuggagugucaguauguug

SEQ ID NO: 2749 - RNA, 21 nt, artificial
  Completely synthesized
gaugugaaaugcucauacuuu

SEQ ID NO: 2750 - RNA, 21 nt, artificial
  Completely synthesized
acaagaacaacuccaaaagga

SEQ ID NO: 2751 - RNA, 21 nt, artificial
  Completely synthesized
aaagccuucaccuacugaaaa

SEQ ID NO: 2752 - RNA, 21 nt, artificial
  Completely synthesized
cuccauaucccauucccugua

SEQ ID NO: 2753 - RNA, 21 nt, artificial
  Completely synthesized
ggcucaucucacaagagauga

SEQ ID NO: 2754 - RNA, 21 nt, artificial
  Completely synthesized
aaacagaaugguccuaaaaca

SEQ ID NO: 2755 - RNA, 21 nt, artificial
  Completely synthesized
cucaguggaaucuuccagcua

SEQ ID NO: 2756 - RNA, 21 nt, artificial
  Completely synthesized
cuuucaaccaaaaccacccug

SEQ ID NO: 2757 - RNA, 21 nt, artificial
  Completely synthesized
aguagguaacuguaguccaca

SEQ ID NO: 2758 - RNA, 21 nt, artificial
  Completely synthesized
aaaagaaguagguaacuguag

SEQ ID NO: 2759 - RNA, 21 nt, artificial
  Completely synthesized
ucaucuauacccucaauggaa

SEQ ID NO: 2760 - RNA, 21 nt, artificial
  Completely synthesized
gcaagauauagaucuuggagu

SEQ ID NO: 2761 - RNA, 21 nt, artificial
  Completely synthesized
cagucacuuguuccugauauu

SEQ ID NO: 2762 - RNA, 21 nt, artificial
  Completely synthesized
gcuccuacugugaugugaaau

SEQ ID NO: 2763 - RNA, 21 nt, artificial
  Completely synthesized
cucccugcagcaaacaagaga

SEQ ID NO: 2764 - RNA, 21 nt, artificial
  Completely synthesized
uagugaauacucccugcagca

SEQ ID NO: 2765 - RNA, 21 nt, artificial
  Completely synthesized
acaaaagccuucaccuacuga

SEQ ID NO: 2766 - RNA, 21 nt, artificial
  Completely synthesized
uggcugcucagaauugcagaa

SEQ ID NO: 2767 - RNA, 21 nt, artificial
  Completely synthesized
aauaaaguggcugcucagaau

SEQ ID NO: 2768 - RNA, 21 nt, artificial
  Completely synthesized
gagcaguucaaugaagcucaa

SEQ ID NO: 2769 - RNA, 21 nt, artificial
  Completely synthesized
cauucccuguagaaaaaauca

SEQ ID NO: 2770 - RNA, 21 nt, artificial
  Completely synthesized
cgacggaaagaguaugagcug

SEQ ID NO: 2771 - RNA, 21 nt, artificial
  Completely synthesized
cuuuugaggauuccuucagca

SEQ ID NO: 2772 - RNA, 21 nt, artificial
  Completely synthesized
uguugauuuagacgguaugca

SEQ ID NO: 2773 - RNA, 21 nt, artificial
  Completely synthesized
agucuucauugcuacuaauca

SEQ ID NO: 2774 - RNA, 21 nt, artificial
  Completely synthesized
guuucagucacuuguuccuga

SEQ ID NO: 2775 - RNA, 21 nt, artificial
  Completely synthesized
aaacaacucagcaccuuauau

SEQ ID NO: 2776 - RNA, 21 nt, artificial
  Completely synthesized
auugcucaaagaaaaaggaga

SEQ ID NO: 2777 - RNA, 21 nt, artificial
  Completely synthesized
accaugguuccaaguccagaa

SEQ ID NO: 2778 - RNA, 21 nt, artificial
  Completely synthesized
uauugaaaaugacaagcuggu

SEQ ID NO: 2779 - RNA, 21 nt, artificial
  Completely synthesized
uagacgguaugcaacaggaca

SEQ ID NO: 2780 - RNA, 21 nt, artificial
  Completely synthesized
gcagacauucccguuuguaga

SEQ ID NO: 2781 - RNA, 21 nt, artificial
  Completely synthesized
gcacauccagucagaaaccag

SEQ ID NO: 2782 - RNA, 21 nt, artificial
  Completely synthesized
guugaaucaguaguuucacuu

SEQ ID NO: 2783 - RNA, 21 nt, artificial
  Completely synthesized
auuggagugucaguauguuga

SEQ ID NO: 2784 - RNA, 21 nt, artificial
  Completely synthesized
cgaaguuuucagcaugcuacg

SEQ ID NO: 2785 - RNA, 21 nt, artificial
  Completely synthesized
cuucaccuacugaaaaaacaa

SEQ ID NO: 2786 - RNA, 21 nt, artificial
  Completely synthesized
acuugaaaaggaaagacaaga

SEQ ID NO: 2787 - RNA, 21 nt, artificial
  Completely synthesized
cagcuauggagacacacuacu

SEQ ID NO: 2788 - RNA, 21 nt, artificial
  Completely synthesized
aacuguaguccacauuuucuu

SEQ ID NO: 2789 - RNA, 21 nt, artificial
  Completely synthesized
cuaccaugguuccaaguccag

SEQ ID NO: 2790 - RNA, 21 nt, artificial
  Completely synthesized
acaagcugguugagacuacca

SEQ ID NO: 2791 - RNA, 21 nt, artificial
  Completely synthesized
agacgguaugcaacaggacau

SEQ ID NO: 2792 - RNA, 21 nt, artificial
  Completely synthesized
guuuguagaugacaaugaggu

SEQ ID NO: 2793 - RNA, 21 nt, artificial
  Completely synthesized
acugugaugugaaaugcucau

SEQ ID NO: 2794 - RNA, 21 nt, artificial
  Completely synthesized
agaacaacuccaaaaggagca

SEQ ID NO: 2795 - RNA, 21 nt, artificial
  Completely synthesized
caagaacaacuccaaaaggag

SEQ ID NO: 2796 - RNA, 21 nt, artificial
  Completely synthesized
agugaauacucccugcagcaa

SEQ ID NO: 2797 - RNA, 21 nt, artificial
  Completely synthesized
aaaugauguccaaagagcagu

SEQ ID NO: 2798 - RNA, 21 nt, artificial
  Completely synthesized
gggauaugguacaacccuugu

SEQ ID NO: 2799 - RNA, 21 nt, artificial
  Completely synthesized
ucaaugauucugacuccggca

SEQ ID NO: 2800 - RNA, 21 nt, artificial
  Completely synthesized
cuaaaugggcccauugauguu

SEQ ID NO: 2801 - RNA, 21 nt, artificial
  Completely synthesized
gguaacuguaguccacauuuu

SEQ ID NO: 2802 - RNA, 21 nt, artificial
  Completely synthesized
aaucaggcucagucaccugaa

SEQ ID NO: 2803 - RNA, 21 nt, artificial
  Completely synthesized
gauugacauacuuuggaggca

SEQ ID NO: 2804 - RNA, 21 nt, artificial
  Completely synthesized
aauucagccagcccagcacau

SEQ ID NO: 2805 - RNA, 21 nt, artificial
  Completely synthesized
ccuuuuucgcucaguuacaac

SEQ ID NO: 2806 - RNA, 21 nt, artificial
  Completely synthesized
agagaaagccuuuuucgcuca

SEQ ID NO: 2807 - RNA, 21 nt, artificial
  Completely synthesized
uaugacaucuggcuaaaaaga

SEQ ID NO: 2808 - RNA, 21 nt, artificial
  Completely synthesized
ccauuugggcuaguuucugug

SEQ ID NO: 2809 - RNA, 21 nt, artificial
  Completely synthesized
auguuuuccuuguucccaaaa

SEQ ID NO: 2810 - RNA, 21 nt, artificial
  Completely synthesized
ccuagugaauacucccugcag

SEQ ID NO: 2811 - RNA, 21 nt, artificial
  Completely synthesized
gguaagaauaaaguggcugcu

SEQ ID NO: 2812 - RNA, 21 nt, artificial
  Completely synthesized
ucugacuccggcauuucacua

SEQ ID NO: 2813 - RNA, 21 nt, artificial
  Completely synthesized
cagaauucaaugauucugacu

SEQ ID NO: 2814 - RNA, 21 nt, artificial
  Completely synthesized
ccuguugauuuagacgguaug

SEQ ID NO: 2815 - RNA, 21 nt, artificial
  Completely synthesized
ggcucagucaccugaaacuuc

SEQ ID NO: 2816 - RNA, 21 nt, artificial
  Completely synthesized
ucuucggcuacguuucaguca

SEQ ID NO: 2817 - RNA, 21 nt, artificial
  Completely synthesized
cagucagaaaccaguggaucu

SEQ ID NO: 2818 - RNA, 21 nt, artificial
  Completely synthesized
gagaaagccuuuuucgcucag

SEQ ID NO: 2819 - RNA, 21 nt, artificial
  Completely synthesized
aguaagaagccagauguuaag

SEQ ID NO: 2820 - RNA, 21 nt, artificial
  Completely synthesized
aaaaacaacucagcaccuuau

SEQ ID NO: 2821 - RNA, 21 nt, artificial
  Completely synthesized
gaaaaaacaacucagcaccuu

SEQ ID NO: 2822 - RNA, 21 nt, artificial
  Completely synthesized
uuccaguuuucuuuuucugca

SEQ ID NO: 2823 - RNA, 21 nt, artificial
  Completely synthesized
uuuuccagcucauacucuuuc

SEQ ID NO: 2824 - RNA, 21 nt, artificial
  Completely synthesized
uucugagcagccacuuuauuc

SEQ ID NO: 2825 - RNA, 21 nt, artificial
  Completely synthesized
uucuguuuuuccagcucauac

SEQ ID NO: 2826 - RNA, 21 nt, artificial
  Completely synthesized
uuuccaucuucaucacguagc

SEQ ID NO: 2827 - RNA, 21 nt, artificial
  Completely synthesized
ucuuccacuucagaaucacug

SEQ ID NO: 2828 - RNA, 21 nt, artificial
  Completely synthesized
ucacauugggcaucaugcacg

SEQ ID NO: 2829 - RNA, 21 nt, artificial
  Completely synthesized
uuucagggugguuuugguuga

SEQ ID NO: 2830 - RNA, 21 nt, artificial
  Completely synthesized
uuaaugaguucacugucaacu

SEQ ID NO: 2831 - RNA, 21 nt, artificial
  Completely synthesized
uuguucuugucuuuccuuuuc

SEQ ID NO: 2832 - RNA, 21 nt, artificial
  Completely synthesized
aaggcuuuugucauuuucucc

SEQ ID NO: 2833 - RNA, 21 nt, artificial
  Completely synthesized
augaagacugggcucucgaug

SEQ ID NO: 2834 - RNA, 21 nt, artificial
  Completely synthesized
cauagugguuaguuuugcaau

SEQ ID NO: 2835 - RNA, 21 nt, artificial
  Completely synthesized
uucucacauugggcaucaugc

SEQ ID NO: 2836 - RNA, 21 nt, artificial
  Completely synthesized
cuuucagggugguuuugguug

SEQ ID NO: 2837 - RNA, 21 nt, artificial
  Completely synthesized
uaagguuuuccaucuucauca

SEQ ID NO: 2838 - RNA, 21 nt, artificial
  Completely synthesized
uacguauaucccgaauuaaug

SEQ ID NO: 2839 - RNA, 21 nt, artificial
  Completely synthesized
uugaagucaacaacagggagg

SEQ ID NO: 2840 - RNA, 21 nt, artificial
  Completely synthesized
uugugagaugagccuccaagc

SEQ ID NO: 2841 - RNA, 21 nt, artificial
  Completely synthesized
uucuguuugacacuuccaggg

SEQ ID NO: 2842 - RNA, 21 nt, artificial
  Completely synthesized
uacugggcucagcuaugaaag

SEQ ID NO: 2843 - RNA, 21 nt, artificial
  Completely synthesized
uuggcuucuggacuuggaacc

SEQ ID NO: 2844 - RNA, 21 nt, artificial
  Completely synthesized
aauagcuccucccaaacuugc

SEQ ID NO: 2845 - RNA, 21 nt, artificial
  Completely synthesized
uuuccgaugaccaggacuuac

SEQ ID NO: 2846 - RNA, 21 nt, artificial
  Completely synthesized
uguucuggugaugccacacug

SEQ ID NO: 2847 - RNA, 21 nt, artificial
  Completely synthesized
ugaaaugccggagucagaauc

SEQ ID NO: 2848 - RNA, 21 nt, artificial
  Completely synthesized
uuuggcuucuggacuuggaac

SEQ ID NO: 2849 - RNA, 21 nt, artificial
  Completely synthesized
ucaucuaguuguaacugagcg

SEQ ID NO: 2850 - RNA, 21 nt, artificial
  Completely synthesized
uguugcauaccgucuaaauca

SEQ ID NO: 2851 - RNA, 21 nt, artificial
  Completely synthesized
uacacuuacacagaaacuagc

SEQ ID NO: 2852 - RNA, 21 nt, artificial
  Completely synthesized
uuuggcuaugauuuugcauag

SEQ ID NO: 2853 - RNA, 21 nt, artificial
  Completely synthesized
uuucguugaagucaacaacag

SEQ ID NO: 2854 - RNA, 21 nt, artificial
  Completely synthesized
uucuuaacaucuggcuucuua

SEQ ID NO: 2855 - RNA, 21 nt, artificial
  Completely synthesized
ucaacaacagggagguuaaug

SEQ ID NO: 2856 - RNA, 21 nt, artificial
  Completely synthesized
uuugcccuaaguucaucucuu

SEQ ID NO: 2857 - RNA, 21 nt, artificial
  Completely synthesized
uucugcugugcuuucagggug

SEQ ID NO: 2858 - RNA, 21 nt, artificial
  Completely synthesized
uuuccauugaggguauagaug

SEQ ID NO: 2859 - RNA, 21 nt, artificial
  Completely synthesized
ucaauguccuguugcauaccg

SEQ ID NO: 2860 - RNA, 21 nt, artificial
  Completely synthesized
uuucacaucacaguaggagcu

SEQ ID NO: 2861 - RNA, 21 nt, artificial
  Completely synthesized
auuucguugaagucaacaaca

SEQ ID NO: 2862 - RNA, 21 nt, artificial
  Completely synthesized
uacuucucgacuuacuccaag

SEQ ID NO: 2863 - RNA, 21 nt, artificial
  Completely synthesized
uugucaacuucugucaguuug

SEQ ID NO: 2864 - RNA, 21 nt, artificial
  Completely synthesized
uuucugacuggaugugcuggg

SEQ ID NO: 2865 - RNA, 21 nt, artificial
  Completely synthesized
auugccaucucuuguuugcug

SEQ ID NO: 2866 - RNA, 21 nt, artificial
  Completely synthesized
uugcugauacugggcucagcu

SEQ ID NO: 2867 - RNA, 21 nt, artificial
  Completely synthesized
uauaucuugccuccaaaguau

SEQ ID NO: 2868 - RNA, 21 nt, artificial
  Completely synthesized
ugagcagccacuuuauucuua

SEQ ID NO: 2869 - RNA, 21 nt, artificial
  Completely synthesized
uugaacugcucuuuggacauc

SEQ ID NO: 2870 - RNA, 21 nt, artificial
  Completely synthesized
augccggagucagaaucauug

SEQ ID NO: 2871 - RNA, 21 nt, artificial
  Completely synthesized
auguggacuacaguuaccuac

SEQ ID NO: 2872 - RNA, 21 nt, artificial
  Completely synthesized
uucuuuuuccauugaggguau

SEQ ID NO: 2873 - RNA, 21 nt, artificial
  Completely synthesized
uccaagaucuauaucuugccu

SEQ ID NO: 2874 - RNA, 21 nt, artificial
  Completely synthesized
uuagccagaugucauaucauc

SEQ ID NO: 2875 - RNA, 21 nt, artificial
  Completely synthesized
uuucucuugcuccuuuuggag

SEQ ID NO: 2876 - RNA, 21 nt, artificial
  Completely synthesized
uauaucccgaauuaaugcaag

SEQ ID NO: 2877 - RNA, 21 nt, artificial
  Completely synthesized
uucaucucuugugagaugagc

SEQ ID NO: 2878 - RNA, 21 nt, artificial
  Completely synthesized
ucucuugugagaugagccucc

SEQ ID NO: 2879 - RNA, 21 nt, artificial
  Completely synthesized
uccacuucagaaucacugagg

SEQ ID NO: 2880 - RNA, 21 nt, artificial
  Completely synthesized
uuugggaaugugggcaaccug

SEQ ID NO: 2881 - RNA, 21 nt, artificial
  Completely synthesized
uugggaacaaggaaaacauug

SEQ ID NO: 2882 - RNA, 21 nt, artificial
  Completely synthesized
aguuuuuucuguuuuuccagc

SEQ ID NO: 2883 - RNA, 21 nt, artificial
  Completely synthesized
ucguugaagucaacaacaggg

SEQ ID NO: 2884 - RNA, 21 nt, artificial
  Completely synthesized
uuugguugaaagcuuugcaaa

SEQ ID NO: 2885 - RNA, 21 nt, artificial
  Completely synthesized
uugacuguggcaucugaauuu

SEQ ID NO: 2886 - RNA, 21 nt, artificial
  Completely synthesized
ugaaacguagccgaagaaacc

SEQ ID NO: 2887 - RNA, 21 nt, artificial
  Completely synthesized
aaugucugcgccaaaagcugc

SEQ ID NO: 2888 - RNA, 21 nt, artificial
  Completely synthesized
ucaccugucucuucaucuagu

SEQ ID NO: 2889 - RNA, 21 nt, artificial
  Completely synthesized
uuuuagccagaugucauauca

SEQ ID NO: 2890 - RNA, 21 nt, artificial
  Completely synthesized
uucaguaggugaaggcuuuug

SEQ ID NO: 2891 - RNA, 21 nt, artificial
  Completely synthesized
ugaaggcuuuugucauuuucu

SEQ ID NO: 2892 - RNA, 21 nt, artificial
  Completely synthesized
acguauaucccgaauuaaugc

SEQ ID NO: 2893 - RNA, 21 nt, artificial
  Completely synthesized
uuuugguugaaagcuuugcaa

SEQ ID NO: 2894 - RNA, 21 nt, artificial
  Completely synthesized
aaugaguucacugucaacugg

SEQ ID NO: 2895 - RNA, 21 nt, artificial
  Completely synthesized
ucuucuguggagaggaugcug

SEQ ID NO: 2896 - RNA, 21 nt, artificial
  Completely synthesized
ugaaaacuucgagauauaagg

SEQ ID NO: 2897 - RNA, 21 nt, artificial
  Completely synthesized
uucguugaagucaacaacagg

SEQ ID NO: 2898 - RNA, 21 nt, artificial
  Completely synthesized
gauagaucagaaacaucaaug

SEQ ID NO: 2899 - RNA, 21 nt, artificial
  Completely synthesized
ucaaauacuucucgacuuacu

SEQ ID NO: 2900 - RNA, 21 nt, artificial
  Completely synthesized
ucucgacuuacuccaagaucu

SEQ ID NO: 2901 - RNA, 21 nt, artificial
  Completely synthesized
uggacuacaguuaccuacuuc

SEQ ID NO: 2902 - RNA, 21 nt, artificial
  Completely synthesized
ugcagucaucaaaguacaaag

SEQ ID NO: 2903 - RNA, 21 nt, artificial
  Completely synthesized
aaauucaccugucucuucauc

SEQ ID NO: 2904 - RNA, 21 nt, artificial
  Completely synthesized
aguacauagugguuaguuuug

SEQ ID NO: 2905 - RNA, 21 nt, artificial
  Completely synthesized
uuacuuuugggaacaaggaaa

SEQ ID NO: 2906 - RNA, 21 nt, artificial
  Completely synthesized
uggaguuguucuugucuuucc

SEQ ID NO: 2907 - RNA, 21 nt, artificial
  Completely synthesized
ucuugcucuaguucuacuaua

SEQ ID NO: 2908 - RNA, 21 nt, artificial
  Completely synthesized
aauucugcugugcuuucaggg

SEQ ID NO: 2909 - RNA, 21 nt, artificial
  Completely synthesized
uguggcaucugaauuuaauga

SEQ ID NO: 2910 - RNA, 21 nt, artificial
  Completely synthesized
uggcagauccacugguuucug

SEQ ID NO: 2911 - RNA, 21 nt, artificial
  Completely synthesized
agaaauucaccugucucuuca

SEQ ID NO: 2912 - RNA, 21 nt, artificial
  Completely synthesized
uucuuacuuuugggaacaagg

SEQ ID NO: 2913 - RNA, 21 nt, artificial
  Completely synthesized
uuguuugcugcagggaguauu

SEQ ID NO: 2914 - RNA, 21 nt, artificial
  Completely synthesized
uguuugcugcagggaguauuc

SEQ ID NO: 2915 - RNA, 21 nt, artificial
  Completely synthesized
uguuuuuucaguaggugaagg

SEQ ID NO: 2916 - RNA, 21 nt, artificial
  Completely synthesized
ucuagcucuuccacuucagaa

SEQ ID NO: 2917 - RNA, 21 nt, artificial
  Completely synthesized
uuccacuucagaaucacugag

SEQ ID NO: 2918 - RNA, 21 nt, artificial
  Completely synthesized
uuugcaaagugauagaucaga

SEQ ID NO: 2919 - RNA, 21 nt, artificial
  Completely synthesized
ugucaucuacaaacgggaaug

SEQ ID NO: 2920 - RNA, 21 nt, artificial
  Completely synthesized
uucucuugcuccuuuuggagu

SEQ ID NO: 2921 - RNA, 21 nt, artificial
  Completely synthesized
aaugcaaguugagcuucauug

SEQ ID NO: 2922 - RNA, 21 nt, artificial
  Completely synthesized
uuucucugguguguucucaca

SEQ ID NO: 2923 - RNA, 21 nt, artificial
  Completely synthesized
guuuuaggaccauucuguuug

SEQ ID NO: 2924 - RNA, 21 nt, artificial
  Completely synthesized
uuaggaccauucuguuugaca

SEQ ID NO: 2925 - RNA, 21 nt, artificial
  Completely synthesized
uugaauucugcugugcuuuca

SEQ ID NO: 2926 - RNA, 21 nt, artificial
  Completely synthesized
agcagaauaaaauucaucacc

SEQ ID NO: 2927 - RNA, 21 nt, artificial
  Completely synthesized
uuuuccauugaggguauagau

SEQ ID NO: 2928 - RNA, 21 nt, artificial
  Completely synthesized
guagccgaagaaaccucauug

SEQ ID NO: 2929 - RNA, 21 nt, artificial
  Completely synthesized
ucaaauccuccuaaaucuagu

SEQ ID NO: 2930 - RNA, 21 nt, artificial
  Completely synthesized
auaagguuuuccaucuucauc

SEQ ID NO: 2931 - RNA, 21 nt, artificial
  Completely synthesized
aggcuuuugucauuuucuccu

SEQ ID NO: 2932 - RNA, 21 nt, artificial
  Completely synthesized
aucucuugugagaugagccuc

SEQ ID NO: 2933 - RNA, 21 nt, artificial
  Completely synthesized
uuccgaugaccaggacuuaca

SEQ ID NO: 2934 - RNA, 21 nt, artificial
  Completely synthesized
ugugcuuucagggugguuuug

SEQ ID NO: 2935 - RNA, 21 nt, artificial
  Completely synthesized
ugcuuucagggugguuuuggu

SEQ ID NO: 2936 - RNA, 21 nt, artificial
  Completely synthesized
ucaaugggcccauuuagaagu

SEQ ID NO: 2937 - RNA, 21 nt, artificial
  Completely synthesized
aauucaucaccaaaaucugug

SEQ ID NO: 2938 - RNA, 21 nt, artificial
  Completely synthesized
acuuacuccaagaucuauauc

SEQ ID NO: 2939 - RNA, 21 nt, artificial
  Completely synthesized
ucuauaucuugccuccaaagu

SEQ ID NO: 2940 - RNA, 21 nt, artificial
  Completely synthesized
aucaaugggcccauuuagaag

SEQ ID NO: 2941 - RNA, 21 nt, artificial
  Completely synthesized
uagaaguucagagagugaaug

SEQ ID NO: 2942 - RNA, 21 nt, artificial
  Completely synthesized
ucuguguugacuguggcaucu

SEQ ID NO: 2943 - RNA, 21 nt, artificial
  Completely synthesized
uucuguggagaggaugcugcu

SEQ ID NO: 2944 - RNA, 21 nt, artificial
  Completely synthesized
ugauaauugucaacuucuguc

SEQ ID NO: 2945 - RNA, 21 nt, artificial
  Completely synthesized
auaauugucaacuucugucag

SEQ ID NO: 2946 - RNA, 21 nt, artificial
  Completely synthesized
uccucccaaacuugcucaaug

SEQ ID NO: 2947 - RNA, 21 nt, artificial
  Completely synthesized
ucgaugugaccgggaauauca

SEQ ID NO: 2948 - RNA, 21 nt, artificial
  Completely synthesized
aucuacaaacgggaaugucug

SEQ ID NO: 2949 - RNA, 21 nt, artificial
  Completely synthesized
aucaaauccauguccugcugg

SEQ ID NO: 2950 - RNA, 21 nt, artificial
  Completely synthesized
aaaugguguccuaagaaauug

SEQ ID NO: 2951 - RNA, 21 nt, artificial
  Completely synthesized
aucacaguaggagcuuuuagu

SEQ ID NO: 2952 - RNA, 21 nt, artificial
  Completely synthesized
uucuugucuuuccuuuucaag

SEQ ID NO: 2953 - RNA, 21 nt, artificial
  Completely synthesized
ugaucuaaaucuugcucuagu

SEQ ID NO: 2954 - RNA, 21 nt, artificial
  Completely synthesized
uucuacagggaaugggauaug

SEQ ID NO: 2955 - RNA, 21 nt, artificial
  Completely synthesized
augggauauggagagcuuuug

SEQ ID NO: 2956 - RNA, 21 nt, artificial
  Completely synthesized
uccgaugaccaggacuuacag

SEQ ID NO: 2957 - RNA, 21 nt, artificial
  Completely synthesized
uaggaccauucuguuugacac

SEQ ID NO: 2958 - RNA, 21 nt, artificial
  Completely synthesized
ucagggugguuuugguugaaa

SEQ ID NO: 2959 - RNA, 21 nt, artificial
  Completely synthesized
agugauagaucagaaacauca

SEQ ID NO: 2960 - RNA, 21 nt, artificial
  Completely synthesized
uacuucuuuuuccauugaggg

SEQ ID NO: 2961 - RNA, 21 nt, artificial
  Completely synthesized
uugaggguauagaugaguaaa

SEQ ID NO: 2962 - RNA, 21 nt, artificial
  Completely synthesized
uucugucaguuuggcuucugg

SEQ ID NO: 2963 - RNA, 21 nt, artificial
  Completely synthesized
ugucaguuuggcuucuggacu

SEQ ID NO: 2964 - RNA, 21 nt, artificial
  Completely synthesized
auuaagacacuguaacucagg

SEQ ID NO: 2965 - RNA, 21 nt, artificial
  Completely synthesized
ugagccugauuaguagcaaug

SEQ ID NO: 2966 - RNA, 21 nt, artificial
  Completely synthesized
caaaguaugucaaucaaaucc

SEQ ID NO: 2967 - RNA, 21 nt, artificial
  Completely synthesized
aucaugaugagcuguggaccg

SEQ ID NO: 2968 - RNA, 21 nt, artificial
  Completely synthesized
cugaauugggagaaauucacc

SEQ ID NO: 2969 - RNA, 21 nt, artificial
  Completely synthesized
uaacaucuggcuucuuacuuu

SEQ ID NO: 2970 - RNA, 21 nt, artificial
  Completely synthesized
gaaggcuuuugucauuuucuc

SEQ ID NO: 2971 - RNA, 21 nt, artificial
  Completely synthesized
aaaucuugcucuaguucuacu

SEQ ID NO: 2972 - RNA, 21 nt, artificial
  Completely synthesized
ucugagcagccacuuuauucu

SEQ ID NO: 2973 - RNA, 21 nt, artificial
  Completely synthesized
uuuucuacagggaaugggaua

SEQ ID NO: 2974 - RNA, 21 nt, artificial
  Completely synthesized
ucugguguguucucacauugg

SEQ ID NO: 2975 - RNA, 21 nt, artificial
  Completely synthesized
uuccacugaguguucugguga

SEQ ID NO: 2976 - RNA, 21 nt, artificial
  Completely synthesized
ugaguguucuggugaugccac

SEQ ID NO: 2977 - RNA, 21 nt, artificial
  Completely synthesized
uugguugaaagcuuugcaaag

SEQ ID NO: 2978 - RNA, 21 nt, artificial
  Completely synthesized
uuuagaaguucagagagugaa

SEQ ID NO: 2979 - RNA, 21 nt, artificial
  Completely synthesized
uaccuacuucuuuuuccauug

SEQ ID NO: 2980 - RNA, 21 nt, artificial
  Completely synthesized
augguagucucaaccagcuug

SEQ ID NO: 2981 - RNA, 21 nt, artificial
  Completely synthesized
uaucuugccuccaaaguaugu

SEQ ID NO: 2982 - RNA, 21 nt, artificial
  Completely synthesized
ucuguuuuuccagcucauacu

SEQ ID NO: 2983 - RNA, 21 nt, artificial
  Completely synthesized
augagcuguggaccguguguu

SEQ ID NO: 2984 - RNA, 21 nt, artificial
  Completely synthesized
ugguguguucucacauugggc

SEQ ID NO: 2985 - RNA, 21 nt, artificial
  Completely synthesized
ugguguuuuaggaccauucug

SEQ ID NO: 2986 - RNA, 21 nt, artificial
  Completely synthesized
ucacugaggccaaguagugug

SEQ ID NO: 2987 - RNA, 21 nt, artificial
  Completely synthesized
uccauagcuggaagauuccac

SEQ ID NO: 2988 - RNA, 21 nt, artificial
  Completely synthesized
gugcuuucagggugguuuugg

SEQ ID NO: 2989 - RNA, 21 nt, artificial
  Completely synthesized
aucuguguugacuguggcauc

SEQ ID NO: 2990 - RNA, 21 nt, artificial
  Completely synthesized
cuacaaacgggaaugucugcg

SEQ ID NO: 2991 - RNA, 21 nt, artificial
  Completely synthesized
uuggcagauccacugguuucu

SEQ ID NO: 2992 - RNA, 21 nt, artificial
  Completely synthesized
uauuaagacacuguaacucag

SEQ ID NO: 2993 - RNA, 21 nt, artificial
  Completely synthesized
agcugcaugcagucaucaaag

SEQ ID NO: 2994 - RNA, 21 nt, artificial
  Completely synthesized
uagcaugcugaaaacuucgag

SEQ ID NO: 2995 - RNA, 21 nt, artificial
  Completely synthesized
uuggacaucauuucguugaag

SEQ ID NO: 2996 - RNA, 21 nt, artificial
  Completely synthesized
uucucugguguguucucacau

SEQ ID NO: 2997 - RNA, 21 nt, artificial
  Completely synthesized
acuuggaaccaugguagucuc

SEQ ID NO: 2998 - RNA, 21 nt, artificial
  Completely synthesized
uuaagacacuguaacucagga

SEQ ID NO: 2999 - RNA, 21 nt, artificial
  Completely synthesized
uagcuccucccaaacuugcuc

SEQ ID NO: 3000 - RNA, 21 nt, artificial
  Completely synthesized
auaucuugccuccaaaguaug

SEQ ID NO: 3001 - RNA, 21 nt, artificial
  Completely synthesized
ugaagacugggcucucgaugu

SEQ ID NO: 3002 - RNA, 21 nt, artificial
  Completely synthesized
ccucauugucaucuacaaacg

SEQ ID NO: 3003 - RNA, 21 nt, artificial
  Completely synthesized
aaagcaucugauuugggaaug

SEQ ID NO: 3004 - RNA, 21 nt, artificial
  Completely synthesized
ugaauugggagaaauucaccu

SEQ ID NO: 3005 - RNA, 21 nt, artificial
  Completely synthesized
uuguaacugagcgaaaaaggc

SEQ ID NO: 3006 - RNA, 21 nt, artificial
  Completely synthesized
aaggcuuucucuugcuccuuu

SEQ ID NO: 3007 - RNA, 21 nt, artificial
  Completely synthesized
uagcccaaaugguguccuaag

SEQ ID NO: 3008 - RNA, 21 nt, artificial
  Completely synthesized
caacauacugacacuccaaug

SEQ ID NO: 3009 - RNA, 21 nt, artificial
  Completely synthesized
aaaguaugagcauuucacauc

SEQ ID NO: 3010 - RNA, 21 nt, artificial
  Completely synthesized
uccuuuuggaguuguucuugu

SEQ ID NO: 3011 - RNA, 21 nt, artificial
  Completely synthesized
uuuucaguaggugaaggcuuu

SEQ ID NO: 3012 - RNA, 21 nt, artificial
  Completely synthesized
uacagggaaugggauauggag

SEQ ID NO: 3013 - RNA, 21 nt, artificial
  Completely synthesized
ucaucucuugugagaugagcc

SEQ ID NO: 3014 - RNA, 21 nt, artificial
  Completely synthesized
uguuuuaggaccauucuguuu

SEQ ID NO: 3015 - RNA, 21 nt, artificial
  Completely synthesized
uagcuggaagauuccacugag

SEQ ID NO: 3016 - RNA, 21 nt, artificial
  Completely synthesized
cagggugguuuugguugaaag

SEQ ID NO: 3017 - RNA, 21 nt, artificial
  Completely synthesized
uguggacuacaguuaccuacu

SEQ ID NO: 3018 - RNA, 21 nt, artificial
  Completely synthesized
cuacaguuaccuacuucuuuu

SEQ ID NO: 3019 - RNA, 21 nt, artificial
  Completely synthesized
uuccauugaggguauagauga

SEQ ID NO: 3020 - RNA, 21 nt, artificial
  Completely synthesized
acuccaagaucuauaucuugc

SEQ ID NO: 3021 - RNA, 21 nt, artificial
  Completely synthesized
aauaucaggaacaagugacug

SEQ ID NO: 3022 - RNA, 21 nt, artificial
  Completely synthesized
auuucacaucacaguaggagc

SEQ ID NO: 3023 - RNA, 21 nt, artificial
  Completely synthesized
ucucuuguuugcugcagggag

SEQ ID NO: 3024 - RNA, 21 nt, artificial
  Completely synthesized
ugcugcagggaguauucacua

SEQ ID NO: 3025 - RNA, 21 nt, artificial
  Completely synthesized
ucaguaggugaaggcuuuugu

SEQ ID NO: 3026 - RNA, 21 nt, artificial
  Completely synthesized
uucugcaauucugagcagcca

SEQ ID NO: 3027 - RNA, 21 nt, artificial
  Completely synthesized
auucugagcagccacuuuauu

SEQ ID NO: 3028 - RNA, 21 nt, artificial
  Completely synthesized
uugagcuucauugaacugcuc

SEQ ID NO: 3029 - RNA, 21 nt, artificial
  Completely synthesized
ugauuuuuucuacagggaaug

SEQ ID NO: 3030 - RNA, 21 nt, artificial
  Completely synthesized
cagcucauacucuuuccgucg

SEQ ID NO: 3031 - RNA, 21 nt, artificial
  Completely synthesized
ugcugaaggaauccucaaaag

SEQ ID NO: 3032 - RNA, 21 nt, artificial
  Completely synthesized
ugcauaccgucuaaaucaaca

SEQ ID NO: 3033 - RNA, 21 nt, artificial
  Completely synthesized
ugauuaguagcaaugaagacu

SEQ ID NO: 3034 - RNA, 21 nt, artificial
  Completely synthesized
ucaggaacaagugacugaaac

SEQ ID NO: 3035 - RNA, 21 nt, artificial
  Completely synthesized
auauaaggugcugaguuguuu

SEQ ID NO: 3036 - RNA, 21 nt, artificial
  Completely synthesized
ucuccuuuuucuuugagcaau

SEQ ID NO: 3037 - RNA, 21 nt, artificial
  Completely synthesized
uucuggacuuggaaccauggu

SEQ ID NO: 3038 - RNA, 21 nt, artificial
  Completely synthesized
accagcuugucauuuucaaua

SEQ ID NO: 3039 - RNA, 21 nt, artificial
  Completely synthesized
uguccuguugcauaccgucua

SEQ ID NO: 3040 - RNA, 21 nt, artificial
  Completely synthesized
ucuacaaacgggaaugucugc

SEQ ID NO: 3041 - RNA, 21 nt, artificial
  Completely synthesized
cugguuucugacuggaugugc

SEQ ID NO: 3042 - RNA, 21 nt, artificial
  Completely synthesized
aagugaaacuacugauucaac

SEQ ID NO: 3043 - RNA, 21 nt, artificial
  Completely synthesized
ucaacauacugacacuccaau

SEQ ID NO: 3044 - RNA, 21 nt, artificial
  Completely synthesized
cguagcaugcugaaaacuucg

SEQ ID NO: 3045 - RNA, 21 nt, artificial
  Completely synthesized
uuguuuuuucaguaggugaag

SEQ ID NO: 3046 - RNA, 21 nt, artificial
  Completely synthesized
ucuugucuuuccuuuucaagu

SEQ ID NO: 3047 - RNA, 21 nt, artificial
  Completely synthesized
aguagugugucuccauagcug

SEQ ID NO: 3048 - RNA, 21 nt, artificial
  Completely synthesized
aagaaaauguggacuacaguu

SEQ ID NO: 3049 - RNA, 21 nt, artificial
  Completely synthesized
cuggacuuggaaccaugguag

SEQ ID NO: 3050 - RNA, 21 nt, artificial
  Completely synthesized
ugguagucucaaccagcuugu

SEQ ID NO: 3051 - RNA, 21 nt, artificial
  Completely synthesized
auguccuguugcauaccgucu

SEQ ID NO: 3052 - RNA, 21 nt, artificial
  Completely synthesized
accucauugucaucuacaaac

SEQ ID NO: 3053 - RNA, 21 nt, artificial
  Completely synthesized
augagcauuucacaucacagu

SEQ ID NO: 3054 - RNA, 21 nt, artificial
  Completely synthesized
ugcuccuuuuggaguuguucu

SEQ ID NO: 3055 - RNA, 21 nt, artificial
  Completely synthesized
cuccuuuuggaguuguucuug

SEQ ID NO: 3056 - RNA, 21 nt, artificial
  Completely synthesized
uugcugcagggaguauucacu

SEQ ID NO: 3057 - RNA, 21 nt, artificial
  Completely synthesized
acugcucuuuggacaucauuu

SEQ ID NO: 3058 - RNA, 21 nt, artificial
  Completely synthesized
acaaggguuguaccauauccc

SEQ ID NO: 3059 - RNA, 21 nt, artificial
  Completely synthesized
ugccggagucagaaucauuga

SEQ ID NO: 3060 - RNA, 21 nt, artificial
  Completely synthesized
aacaucaaugggcccauuuag

SEQ ID NO: 3061 - RNA, 21 nt, artificial
  Completely synthesized
aaaauguggacuacaguuacc

SEQ ID NO: 3062 - RNA, 21 nt, artificial
  Completely synthesized
uucaggugacugagccugauu

SEQ ID NO: 3063 - RNA, 21 nt, artificial
  Completely synthesized
ugccuccaaaguaugucaauc

SEQ ID NO: 3064 - RNA, 21 nt, artificial
  Completely synthesized
augugcugggcuggcugaauu

SEQ ID NO: 3065 - RNA, 21 nt, artificial
  Completely synthesized
guuguaacugagcgaaaaagg

SEQ ID NO: 3066 - RNA, 21 nt, artificial
  Completely synthesized
ugagcgaaaaaggcuuucucu

SEQ ID NO: 3067 - RNA, 21 nt, artificial
  Completely synthesized
ucuuuuuagccagaugucaua

SEQ ID NO: 3068 - RNA, 21 nt, artificial
  Completely synthesized
cacagaaacuagcccaaaugg

SEQ ID NO: 3069 - RNA, 21 nt, artificial
  Completely synthesized
uuuugggaacaaggaaaacau

SEQ ID NO: 3070 - RNA, 21 nt, artificial
  Completely synthesized
cugcagggaguauucacuagg

SEQ ID NO: 3071 - RNA, 21 nt, artificial
  Completely synthesized
agcagccacuuuauucuuacc

SEQ ID NO: 3072 - RNA, 21 nt, artificial
  Completely synthesized
uagugaaaugccggagucaga

SEQ ID NO: 3073 - RNA, 21 nt, artificial
  Completely synthesized
agucagaaucauugaauucug

SEQ ID NO: 3074 - RNA, 21 nt, artificial
  Completely synthesized
cauaccgucuaaaucaacagg

SEQ ID NO: 3075 - RNA, 21 nt, artificial
  Completely synthesized
gaaguuucaggugacugagcc

SEQ ID NO: 3076 - RNA, 21 nt, artificial
  Completely synthesized
ugacugaaacguagccgaaga

SEQ ID NO: 3077 - RNA, 21 nt, artificial
  Completely synthesized
agauccacugguuucugacug

SEQ ID NO: 3078 - RNA, 21 nt, artificial
  Completely synthesized
cugagcgaaaaaggcuuucuc

SEQ ID NO: 3079 - RNA, 21 nt, artificial
  Completely synthesized
cuuaacaucuggcuucuuacu

SEQ ID NO: 3080 - RNA, 21 nt, artificial
  Completely synthesized
auaaggugcugaguuguuuuu

SEQ ID NO: 3081 - RNA, 21 nt, Artificial
  Completely synthesized
aaggugcugaguuguuuuuuc

SEQ ID NO: 3082 - RNA, 23 nt, artificial
  Completely synthesized
ccuguaaguccuggucaucggaa

SEQ ID NO: 3083 - RNA, 23 nt, artificial
  Completely synthesized
cagugaacucauuaaauucagau

SEQ ID NO: 3084 - RNA, 23 nt, artificial
  Completely synthesized
cuggaaaauauaguagaacuaga

SEQ ID NO: 3085 - RNA, 23 nt, artificial
  Completely synthesized
gcuuuguacuuugaugacugcau

SEQ ID NO: 3086 - RNA, 23 nt, artificial
  Completely synthesized
gccagauguuaagaaaaacuaga

SEQ ID NO: 3087 - RNA, 23 nt, artificial
  Completely synthesized
ccagauguuaagaaaaacuagau

SEQ ID NO: 3088 - RNA, 23 nt, artificial
  Completely synthesized
caacuagaugaagagacagguga

SEQ ID NO: 3089 - RNA, 23 nt, artificial
  Completely synthesized
gaacuucuaaaugggcccauuga

SEQ ID NO: 3090 - RNA, 23 nt, artificial
  Completely synthesized
caaaaucauagccaaaacuagua

SEQ ID NO: 3091 - RNA, 23 nt, artificial
  Completely synthesized
caguaguuucacuuuaacuguaa

SEQ ID NO: 3092 - RNA, 23 nt, artificial
  Completely synthesized
gaacaacuccaaaaggagcaaga

SEQ ID NO: 3093 - RNA, 23 nt, artificial
  Completely synthesized
gcauuaauucgggauauacguag

SEQ ID NO: 3094 - RNA, 23 nt, artificial
  Completely synthesized
ggcaauguuuuccuuguucccaa

SEQ ID NO: 3095 - RNA, 23 nt, artificial
  Completely synthesized
gaaaauauaguagaacuagagca

SEQ ID NO: 3096 - RNA, 23 nt, artificial
  Completely synthesized
cauuuucuuaaugcuuuugagga

SEQ ID NO: 3097 - RNA, 23 nt, artificial
  Completely synthesized
ccacauuuucuuaaugcuuuuga

SEQ ID NO: 3098 - RNA, 23 nt, artificial
  Completely synthesized
cagaaaaaacuugaaaaggaaag

SEQ ID NO: 3099 - RNA, 23 nt, artificial
  Completely synthesized
acuuuaagccauucacucucuga

SEQ ID NO: 3100 - RNA, 23 nt, artificial
  Completely synthesized
cuggcuaaaaagaaauuauugca

SEQ ID NO: 3101 - RNA, 23 nt, artificial
  Completely synthesized
ggccucagugauucugaagugga

SEQ ID NO: 3102 - RNA, 23 nt, artificial
  Completely synthesized
ggugaugaauuuuauucugcuuu

SEQ ID NO: 3103 - RNA, 23 nt, artificial
  Completely synthesized
cuuugaugacugcaugcagcuuu

SEQ ID NO: 3104 - RNA, 23 nt, artificial
  Completely synthesized
gacacacuacuuggccucaguga

SEQ ID NO: 3105 - RNA, 23 nt, artificial
  Completely synthesized
uggugaugaauuuuauucugcuu

SEQ ID NO: 3106 - RNA, 23 nt, artificial
  Completely synthesized
cuuaaugcuuuugaggauuccuu

SEQ ID NO: 3107 - RNA, 23 nt, artificial
  Completely synthesized
caagaacaacuccaaaaggagca

SEQ ID NO: 3108 - RNA, 23 nt, artificial
  Completely synthesized
gagaaagccuuuuucgcucaguu

SEQ ID NO: 3109 - RNA, 23 nt, artificial
  Completely synthesized
ccuagugaauacucccugcagca

SEQ ID NO: 3110 - RNA, 23 nt, artificial
  Completely synthesized
aaguauuugacuucagucagcga

SEQ ID NO: 3111 - RNA, 23 nt, artificial
  Completely synthesized
ugauauucccggucacaucgaga

SEQ ID NO: 3112 - RNA, 23 nt, artificial
  Completely synthesized
agaaagccuuuuucgcucaguua

SEQ ID NO: 3113 - RNA, 23 nt, artificial
  Completely synthesized
agugucaaacagaaugguccuaa

SEQ ID NO: 3114 - RNA, 23 nt, artificial
  Completely synthesized
augguuccaaguccagaagccaa

SEQ ID NO: 3115 - RNA, 23 nt, artificial
  Completely synthesized
ggauaugguacaacccuugucac

SEQ ID NO: 3116 - RNA, 23 nt, artificial
  Completely synthesized
gguaacuguaguccacauuuucu

SEQ ID NO: 3117 - RNA, 23 nt, artificial
  Completely synthesized
guggaaucuuccagcuauggaga

SEQ ID NO: 3118 - RNA, 23 nt, artificial
  Completely synthesized
ucauuuuuacucaucuauacccu

SEQ ID NO: 3119 - RNA, 23 nt, artificial
  Completely synthesized
cccaaaucagaugcuuuguacuu

SEQ ID NO: 3120 - RNA, 23 nt, artificial
  Completely synthesized
caaaaggagcaagagaaagccuu

SEQ ID NO: 3121 - RNA, 23 nt, artificial
  Completely synthesized
ggaaaauauaguagaacuagagc

SEQ ID NO: 3122 - RNA, 23 nt, artificial
  Completely synthesized
gcucaacuugcauuaauucggga

SEQ ID NO: 3123 - RNA, 23 nt, artificial
  Completely synthesized
gaagugucaaacagaaugguccu

SEQ ID NO: 3124 - RNA, 23 nt, artificial
  Completely synthesized
aauauugaaaaugacaagcuggu

SEQ ID NO: 3125 - RNA, 23 nt, artificial
  Completely synthesized
gauuuaggaggauuugaccuuuu

SEQ ID NO: 3126 - RNA, 23 nt, artificial
  Completely synthesized
gaaaaauugcucaaagaaaaagg

SEQ ID NO: 3127 - RNA, 23 nt, artificial
  Completely synthesized
agaauugcagaaaaagaaaacug

SEQ ID NO: 3128 - RNA, 23 nt, artificial
  Completely synthesized
ugaaaaugacaagcugguugaga

SEQ ID NO: 3129 - RNA, 23 nt, artificial
  Completely synthesized
gcucagucaccugaaacuucugu

SEQ ID NO: 3130 - RNA, 23 nt, artificial
  Completely synthesized
auaugaugauaugacaucuggcu

SEQ ID NO: 3131 - RNA, 23 nt, artificial
  Completely synthesized
cuauuauacuaaaagcuccuacu

SEQ ID NO: 3132 - RNA, 23 nt, artificial
  Completely synthesized
gcuuucauagcugagcccaguau

SEQ ID NO: 3133 - RNA, 23 nt, artificial
  Completely synthesized
uuuuauucugcuuucauagcuga

SEQ ID NO: 3134 - RNA, 23 nt, artificial
  Completely synthesized
gacaagcugguugagacuaccau

SEQ ID NO: 3135 - RNA, 23 nt, artificial
  Completely synthesized
aaacuagauuuaggaggauuuga

SEQ ID NO: 3136 - RNA, 23 nt, artificial
  Completely synthesized
aaggaaagacaagaacaacucca

SEQ ID NO: 3137 - RNA, 23 nt, artificial
  Completely synthesized
aacacacgguccacagcucauca

SEQ ID NO: 3138 - RNA, 23 nt, artificial
  Completely synthesized
aagugucaaacagaaugguccua

SEQ ID NO: 3139 - RNA, 23 nt, artificial
  Completely synthesized
uaaacacaagucccaguguggca

SEQ ID NO: 3140 - RNA, 23 nt, artificial
  Completely synthesized
cauuucacuaaacacaaguccca

SEQ ID NO: 3141 - RNA, 23 nt, artificial
  Completely synthesized
guaucagcaacagcaugcccuca

SEQ ID NO: 3142 - RNA, 23 nt, artificial
  Completely synthesized
acagugaacucauuaaauucaga

SEQ ID NO: 3143 - RNA, 23 nt, artificial
  Completely synthesized
acgaaacuuuaaaaagcauugga

SEQ ID NO: 3144 - RNA, 23 nt, artificial
  Completely synthesized
guacuauuauacuaaaagcuccu

SEQ ID NO: 3145 - RNA, 23 nt, artificial
  Completely synthesized
gaaaaaaucauuaaccucccugu

SEQ ID NO: 3146 - RNA, 23 nt, artificial
  Completely synthesized
ccuguagaaaaaaucauuaaccu

SEQ ID NO: 3147 - RNA, 23 nt, artificial
  Completely synthesized
auuuuuacucaucuauacccuca

SEQ ID NO: 3148 - RNA, 23 nt, artificial
  Completely synthesized
acuggaaaauauaguagaacuag

SEQ ID NO: 3149 - RNA, 23 nt, artificial
  Completely synthesized
gaacuuagggcaaaagcucucca

SEQ ID NO: 3150 - RNA, 23 nt, artificial
  Completely synthesized
caccagagaaagaauugccugua

SEQ ID NO: 3151 - RNA, 23 nt, artificial
  Completely synthesized
ugaugacugcaugcagcuuuugg

SEQ ID NO: 3152 - RNA, 23 nt, artificial
  Completely synthesized
cuagugaauacucccugcagcaa

SEQ ID NO: 3153 - RNA, 23 nt, artificial
  Completely synthesized
cuuauaucucgaaguuuucagca

SEQ ID NO: 3154 - RNA, 23 nt, artificial
  Completely synthesized
cuuguuccugauauucccgguca

SEQ ID NO: 3155 - RNA, 23 nt, artificial
  Completely synthesized
cguuucagucacuuguuccugau

SEQ ID NO: 3156 - RNA, 23 nt, artificial
  Completely synthesized
agagaaagccuuuuucgcucagu

SEQ ID NO: 3157 - RNA, 23 nt, artificial
  Completely synthesized
caagagaaagccuuuuucgcuca

SEQ ID NO: 3158 - RNA, 23 nt, artificial
  Completely synthesized
aagaacaacuccaaaaggagcaa

SEQ ID NO: 3159 - RNA, 23 nt, artificial
  Completely synthesized
aaugauguccaaagagcaguuca

SEQ ID NO: 3160 - RNA, 23 nt, artificial
  Completely synthesized
cuacuuggccucagugauucuga

SEQ ID NO: 3161 - RNA, 23 nt, artificial
  Completely synthesized
aguccacauuuucuuaaugcuuu

SEQ ID NO: 3162 - RNA, 23 nt, artificial
  Completely synthesized
acuaaucaggcucagucaccuga

SEQ ID NO: 3163 - RNA, 23 nt, artificial
  Completely synthesized
uccuaaaacaccaguacauucuu

SEQ ID NO: 3164 - RNA, 23 nt, artificial
  Completely synthesized
aaucuuccagcuauggagacaca

SEQ ID NO: 3165 - RNA, 23 nt, artificial
  Completely synthesized
ccucaccugcuacuuuaagccau

SEQ ID NO: 3166 - RNA, 23 nt, artificial
  Completely synthesized
cuuuguacuuugaugacugcaug

SEQ ID NO: 3167 - RNA, 23 nt, artificial
  Completely synthesized
aacuacucccagguugcccacau

SEQ ID NO: 3168 - RNA, 23 nt, artificial
  Completely synthesized
acuguaaacaauuucuuaggaca

SEQ ID NO: 3169 - RNA, 23 nt, artificial
  Completely synthesized
uggaaaauauaguagaacuagag

SEQ ID NO: 3170 - RNA, 23 nt, artificial
  Completely synthesized
cuaaaacaccaguacauucuucu

SEQ ID NO: 3171 - RNA, 23 nt, artificial
  Completely synthesized
gagacacacuacuuggccucagu

SEQ ID NO: 3172 - RNA, 23 nt, artificial
  Completely synthesized
ucuuccagcuauggagacacacu

SEQ ID NO: 3173 - RNA, 23 nt, artificial
  Completely synthesized
caguaucagcaacagcaugcccu

SEQ ID NO: 3174 - RNA, 23 nt, artificial
  Completely synthesized
cugcuuucauagcugagcccagu

SEQ ID NO: 3175 - RNA, 23 nt, artificial
  Completely synthesized
auugaaaaugacaagcugguuga

SEQ ID NO: 3176 - RNA, 23 nt, artificial
  Completely synthesized
uaauauugaaaaugacaagcugg

SEQ ID NO: 3177 - RNA, 23 nt, artificial
  Completely synthesized
gauuugauugacauacuuuggag

SEQ ID NO: 3178 - RNA, 23 nt, artificial
  Completely synthesized
ugcuuuguacuuugaugacugca

SEQ ID NO: 3179 - RNA, 23 nt, artificial
  Completely synthesized
acuacucccagguugcccacauu

SEQ ID NO: 3180 - RNA, 23 nt, artificial
  Completely synthesized
cgaaacuuuaaaaagcauuggag

SEQ ID NO: 3181 - RNA, 23 nt, artificial
  Completely synthesized
cauuaauucgggauauacguagg

SEQ ID NO: 3182 - RNA, 23 nt, artificial
  Completely synthesized
uaaccucccuguuguugacuuca

SEQ ID NO: 3183 - RNA, 23 nt, artificial
  Completely synthesized
gaugaacuuagggcaaaagcucu

SEQ ID NO: 3184 - RNA, 23 nt, artificial
  Completely synthesized
uuugacuucagucagcgacggaa

SEQ ID NO: 3185 - RNA, 23 nt, artificial
  Completely synthesized
auuugacuucagucagcgacgga

SEQ ID NO: 3186 - RNA, 23 nt, artificial
  Completely synthesized
aguauuugacuucagucagcgac

SEQ ID NO: 3187 - RNA, 23 nt, artificial
  Completely synthesized
aagcuuucaaccaaaaccacccu

SEQ ID NO: 3188 - RNA, 23 nt, artificial
  Completely synthesized
gaaaaugacaagcugguugagac

SEQ ID NO: 3189 - RNA, 23 nt, artificial
  Completely synthesized
gaucugccaacuacucccagguu

SEQ ID NO: 3190 - RNA, 23 nt, artificial
  Completely synthesized
uucuuaggacaccauuugggcua

SEQ ID NO: 3191 - RNA, 23 nt, artificial
  Completely synthesized
ucaguaguuucacuuuaacugua

SEQ ID NO: 3192 - RNA, 23 nt, artificial
  Completely synthesized
aaagcuuucaaccaaaaccaccc

SEQ ID NO: 3193 - RNA, 23 nt, artificial
  Completely synthesized
gaaacuucuguugcucagguagc

SEQ ID NO: 3194 - RNA, 23 nt, artificial
  Completely synthesized
acguuucagucacuuguuccuga

SEQ ID NO: 3195 - RNA, 23 nt, artificial
  Completely synthesized
aagagaaagccuuuuucgcucag

SEQ ID NO: 3196 - RNA, 23 nt, artificial
  Completely synthesized
aauucuaugcaaaaucauagcca

SEQ ID NO: 3197 - RNA, 23 nt, artificial
  Completely synthesized
uggagacacacuacuuggccuca

SEQ ID NO: 3198 - RNA, 23 nt, artificial
  Completely synthesized
ccauuccugaguuacagugucuu

SEQ ID NO: 3199 - RNA, 23 nt, artificial
  Completely synthesized
uaugaugauaugacaucuggcua

SEQ ID NO: 3200 - RNA, 23 nt, artificial
  Completely synthesized
auuaauucgggauauacguagga

SEQ ID NO: 3201 - RNA, 23 nt, artificial
  Completely synthesized
auucaagccgcuuggaggcucau

SEQ ID NO: 3202 - RNA, 23 nt, artificial
  Completely synthesized
gaaucuuccagcuauggagacac

SEQ ID NO: 3203 - RNA, 23 nt, artificial
  Completely synthesized
ggaaucuuccagcuauggagaca

SEQ ID NO: 3204 - RNA, 23 nt, artificial
  Completely synthesized
cucugaacuucuaaaugggccca

SEQ ID NO: 3205 - RNA, 23 nt, artificial
  Completely synthesized
aagagacaggugaauuucuccca

SEQ ID NO: 3206 - RNA, 23 nt, artificial
  Completely synthesized
guaguuucacuuuaacuguaaac

SEQ ID NO: 3207 - RNA, 23 nt, artificial
  Completely synthesized
agauuuaggaggauuugaccuuu

SEQ ID NO: 3208 - RNA, 23 nt, artificial
  Completely synthesized
ucuccuagugaauacucccugca

SEQ ID NO: 3209 - RNA, 23 nt, artificial
  Completely synthesized
ccuacugaaaaaacaacucagca

SEQ ID NO: 3210 - RNA, 23 nt, artificial
  Completely synthesized
aaaaaaucauuaaccucccuguu

SEQ ID NO: 3211 - RNA, 23 nt, artificial
  Completely synthesized
guauuugacuucagucagcgacg

SEQ ID NO: 3212 - RNA, 23 nt, artificial
  Completely synthesized
cuuuuggcgcagacauucccguu

SEQ ID NO: 3213 - RNA, 23 nt, artificial
  Completely synthesized
gaaagccuuuuucgcucaguuac

SEQ ID NO: 3214 - RNA, 23 nt, artificial
  Completely synthesized
ggacaccauuugggcuaguuucu

SEQ ID NO: 3215 - RNA, 23 nt, artificial
  Completely synthesized
aaagagcaguucaaugaagcuca

SEQ ID NO: 3216 - RNA, 23 nt, artificial
  Completely synthesized
gauauucccggucacaucgagag

SEQ ID NO: 3217 - RNA, 23 nt, artificial
  Completely synthesized
guuucuucggcuacguuucaguc

SEQ ID NO: 3218 - RNA, 23 nt, artificial
  Completely synthesized
aaugagguuucuucggcuacguu

SEQ ID NO: 3219 - RNA, 23 nt, artificial
  Completely synthesized
auucccaaaucagaugcuuugua

SEQ ID NO: 3220 - RNA, 23 nt, artificial
  Completely synthesized
ugcuuucauagcugagcccagua

SEQ ID NO: 3221 - RNA, 23 nt, artificial
  Completely synthesized
cucagucaccugaaacuucuguu

SEQ ID NO: 3222 - RNA, 23 nt, artificial
  Completely synthesized
uuugaugacugcaugcagcuuuu

SEQ ID NO: 3223 - RNA, 23 nt, artificial
  Completely synthesized
uuauaucucgaaguuuucagcau

SEQ ID NO: 3224 - RNA, 23 nt, artificial
  Completely synthesized
guaagucgagaaguauuugacuu

SEQ ID NO: 3225 - RNA, 23 nt, artificial
  Completely synthesized
agccauucacucucugaacuucu

SEQ ID NO: 3226 - RNA, 23 nt, artificial
  Completely synthesized
uucagaugccacagucaacacag

SEQ ID NO: 3227 - RNA, 23 nt, artificial
  Completely synthesized
ggauuccuucagcagcauccucu

SEQ ID NO: 3228 - RNA, 23 nt, artificial
  Completely synthesized
cauuuuuacucaucuauacccuc

SEQ ID NO: 3229 - RNA, 23 nt, artificial
  Completely synthesized
uaggacaccauuugggcuaguuu

SEQ ID NO: 3230 - RNA, 23 nt, artificial
  Completely synthesized
agaacaacuccaaaaggagcaag

SEQ ID NO: 3231 - RNA, 23 nt, artificial
  Completely synthesized
ugaugcccaaugugagaacacac

SEQ ID NO: 3232 - RNA, 23 nt, artificial
  Completely synthesized
gaauuuuauucugcuuucauagc

SEQ ID NO: 3233 - RNA, 23 nt, artificial
  Completely synthesized
gauuccuucagcagcauccucuc

SEQ ID NO: 3234 - RNA, 23 nt, artificial
  Completely synthesized
gcuauuauccauuccugaguuac

SEQ ID NO: 3235 - RNA, 23 nt, artificial
  Completely synthesized
gcaagagaaagccuuuuucgcuc

SEQ ID NO: 3236 - RNA, 23 nt, artificial
  Completely synthesized
acaagaacaacuccaaaaggagc

SEQ ID NO: 3237 - RNA, 23 nt, artificial
  Completely synthesized
ugacuucaacgaaaugaugucca

SEQ ID NO: 3238 - RNA, 23 nt, artificial
  Completely synthesized
agcucuccauaucccauucccug

SEQ ID NO: 3239 - RNA, 23 nt, artificial
  Completely synthesized
caaacauucaagccgcuuggagg

SEQ ID NO: 3240 - RNA, 23 nt, artificial
  Completely synthesized
gaauugccuguaaguccugguca

SEQ ID NO: 3241 - RNA, 23 nt, artificial
  Completely synthesized
cuaaaugggcccauugauguuuc

SEQ ID NO: 3242 - RNA, 23 nt, artificial
  Completely synthesized
gugaugaauuuuauucugcuuuc

SEQ ID NO: 3243 - RNA, 23 nt, artificial
  Completely synthesized
uugcuacuaaucaggcucaguca

SEQ ID NO: 3244 - RNA, 23 nt, artificial
  Completely synthesized
aggacaccauuugggcuaguuuc

SEQ ID NO: 3245 - RNA, 23 nt, artificial
  Completely synthesized
cuuaggacaccauuugggcuagu

SEQ ID NO: 3246 - RNA, 23 nt, artificial
  Completely synthesized
uauguugaaucaguaguuucacu

SEQ ID NO: 3247 - RNA, 23 nt, artificial
  Completely synthesized
aacuagauuuaggaggauuugac

SEQ ID NO: 3248 - RNA, 23 nt, artificial
  Completely synthesized
ucaaagaaaaaggagaaaaugac

SEQ ID NO: 3249 - RNA, 23 nt, artificial
  Completely synthesized
aaaauugcucaaagaaaaaggag

SEQ ID NO: 3250 - RNA, 23 nt, artificial
  Completely synthesized
aacuuagggcaaaagcucuccau

SEQ ID NO: 3251 - RNA, 23 nt, artificial
  Completely synthesized
acaccagagaaagaauugccugu

SEQ ID NO: 3252 - RNA, 23 nt, artificial
  Completely synthesized
cucucugaacuucuaaaugggcc

SEQ ID NO: 3253 - RNA, 23 nt, artificial
  Completely synthesized
agugaacucauuaaauucagaug

SEQ ID NO: 3254 - RNA, 23 nt, artificial
  Completely synthesized
uuaggacaccauuugggcuaguu

SEQ ID NO: 3255 - RNA, 23 nt, artificial
  Completely synthesized
cuguaaacaauuucuuaggacac

SEQ ID NO: 3256 - RNA, 23 nt, artificial
  Completely synthesized
uuccgaugaccaggacuuacagg

SEQ ID NO: 3257 - RNA, 23 nt, artificial
  Completely synthesized
aucugaauuuaaugaguucacug

SEQ ID NO: 3258 - RNA, 23 nt, artificial
  Completely synthesized
ucuaguucuacuauauuuuccag

SEQ ID NO: 3259 - RNA, 23 nt, artificial
  Completely synthesized
augcagucaucaaaguacaaagc

SEQ ID NO: 3260 - RNA, 23 nt, artificial
  Completely synthesized
ucuaguuuuucuuaacaucuggc

SEQ ID NO: 3261 - RNA, 23 nt, artificial
  Completely synthesized
aucuaguuuuucuuaacaucugg

SEQ ID NO: 3262 - RNA, 23 nt, artificial
  Completely synthesized
ucaccugucucuucaucuaguug

SEQ ID NO: 3263 - RNA, 23 nt, artificial
  Completely synthesized
ucaaugggcccauuuagaaguuc

SEQ ID NO: 3264 - RNA, 23 nt, artificial
  Completely synthesized
uacuaguuuuggcuaugauuuug

SEQ ID NO: 3265 - RNA, 23 nt, artificial
  Completely synthesized
uuacaguuaaagugaaacuacug

SEQ ID NO: 3266 - RNA, 23 nt, artificial
  Completely synthesized
ucuugcuccuuuuggaguuguuc

SEQ ID NO: 3267 - RNA, 23 nt, artificial
  Completely synthesized
cuacguauaucccgaauuaaugc

SEQ ID NO: 3268 - RNA, 23 nt, artificial
  Completely synthesized
uugggaacaaggaaaacauugcc

SEQ ID NO: 3269 - RNA, 23 nt, artificial
  Completely synthesized
ugcucuaguucuacuauauuuuc

SEQ ID NO: 3270 - RNA, 23 nt, artificial
  Completely synthesized
uccucaaaagcauuaagaaaaug

SEQ ID NO: 3271 - RNA, 23 nt, artificial
  Completely synthesized
ucaaaagcauuaagaaaaugugg

SEQ ID NO: 3272 - RNA, 23 nt, artificial
  Completely synthesized
cuuuccuuuucaaguuuuuucug

SEQ ID NO: 3273 - RNA, 23 nt, artificial
  Completely synthesized
ucagagagugaauggcuuaaagu

SEQ ID NO: 3274 - RNA, 23 nt, artificial
  Completely synthesized
ugcaauaauuucuuuuuagccag

SEQ ID NO: 3275 - RNA, 23 nt, artificial
  Completely synthesized
uccacuucagaaucacugaggcc

SEQ ID NO: 3276 - RNA, 23 nt, artificial
  Completely synthesized
aaagcagaauaaaauucaucacc

SEQ ID NO: 3277 - RNA, 23 nt, artificial
  Completely synthesized
aaagcugcaugcagucaucaaag

SEQ ID NO: 3278 - RNA, 23 nt, artificial
  Completely synthesized
ucacugaggccaaguaguguguc

SEQ ID NO: 3279 - RNA, 23 nt, artificial
  Completely synthesized
aagcagaauaaaauucaucacca

SEQ ID NO: 3280 - RNA, 23 nt, artificial
  Completely synthesized
aaggaauccucaaaagcauuaag

SEQ ID NO: 3281 - RNA, 23 nt, artificial
  Completely synthesized
ugcuccuuuuggaguuguucuug

SEQ ID NO: 3282 - RNA, 23 nt, artificial
  Completely synthesized
aacugagcgaaaaaggcuuucuc

SEQ ID NO: 3283 - RNA, 23 nt, artificial
  Completely synthesized
ugcugcagggaguauucacuagg

SEQ ID NO: 3284 - RNA, 23 nt, artificial
  Completely synthesized
ucgcugacugaagucaaauacuu

SEQ ID NO: 3285 - RNA, 23 nt, artificial
  Completely synthesized
ucucgaugugaccgggaauauca

SEQ ID NO: 3286 - RNA, 23 nt, artificial
  Completely synthesized
uaacugagcgaaaaaggcuuucu

SEQ ID NO: 3287 - RNA, 23 nt, artificial
  Completely synthesized
uuaggaccauucuguuugacacu

SEQ ID NO: 3288 - RNA, 23 nt, artificial
  Completely synthesized
uuggcuucuggacuuggaaccau

SEQ ID NO: 3289 - RNA, 23 nt, artificial
  Completely synthesized
gugacaaggguuguaccauaucc

SEQ ID NO: 3290 - RNA, 23 nt, artificial
  Completely synthesized
agaaaauguggacuacaguuacc

SEQ ID NO: 3291 - RNA, 23 nt, artificial
  Completely synthesized
ucuccauagcuggaagauuccac

SEQ ID NO: 3292 - RNA, 23 nt, artificial
  Completely synthesized
aggguauagaugaguaaaaauga

SEQ ID NO: 3293 - RNA, 23 nt, artificial
  Completely synthesized
aaguacaaagcaucugauuuggg

SEQ ID NO: 3294 - RNA, 23 nt, artificial
  Completely synthesized
aaggcuuucucuugcuccuuuug

SEQ ID NO: 3295 - RNA, 23 nt, artificial
  Completely synthesized
gcucuaguucuacuauauuuucc

SEQ ID NO: 3296 - RNA, 23 nt, artificial
  Completely synthesized
ucccgaauuaaugcaaguugagc

SEQ ID NO: 3297 - RNA, 23 nt, artificial
  Completely synthesized
aggaccauucuguuugacacuuc

SEQ ID NO: 3298 - RNA, 23 nt, artificial
  Completely synthesized
accagcuugucauuuucaauauu

SEQ ID NO: 3299 - RNA, 23 nt, artificial
  Completely synthesized
aaaaggucaaauccuccuaaauc

SEQ ID NO: 3300 - RNA, 23 nt, artificial
  Completely synthesized
ccuuuuucuuugagcaauuuuuc

SEQ ID NO: 3301 - RNA, 23 nt, artificial
  Completely synthesized
caguuuucuuuuucugcaauucu

SEQ ID NO: 3302 - RNA, 23 nt, artificial
  Completely synthesized
ucucaaccagcuugucauuuuca

SEQ ID NO: 3303 - RNA, 23 nt, artificial
  Completely synthesized
acagaaguuucaggugacugagc

SEQ ID NO: 3304 - RNA, 23 nt, artificial
  Completely synthesized
agccagaugucauaucaucauau

SEQ ID NO: 3305 - RNA, 23 nt, artificial
  Completely synthesized
aguaggagcuuuuaguauaauag

SEQ ID NO: 3306 - RNA, 23 nt, artificial
  Completely synthesized
auacugggcucagcuaugaaagc

SEQ ID NO: 3307 - RNA, 23 nt, artificial
  Completely synthesized
ucagcuaugaaagcagaauaaaa

SEQ ID NO: 3308 - RNA, 23 nt, artificial
  Completely synthesized
augguagucucaaccagcuuguc

SEQ ID NO: 3309 - RNA, 23 nt, artificial
  Completely synthesized
ucaaauccuccuaaaucuaguuu

SEQ ID NO: 3310 - RNA, 23 nt, artificial
  Completely synthesized
uggaguuguucuugucuuuccuu

SEQ ID NO: 3311 - RNA, 23 nt, artificial
  Completely synthesized
ugaugagcuguggaccguguguu

SEQ ID NO: 3312 - RNA, 23 nt, artificial
  Completely synthesized
uaggaccauucuguuugacacuu

SEQ ID NO: 3313 - RNA, 23 nt, artificial
  Completely synthesized
ugccacacugggacuuguguuua

SEQ ID NO: 3314 - RNA, 23 nt, artificial
  Completely synthesized
ugggacuuguguuuagugaaaug

SEQ ID NO: 3315 - RNA, 23 nt, artificial
  Completely synthesized
ugagggcaugcuguugcugauac

SEQ ID NO: 3316 - RNA, 23 nt, artificial
  Completely synthesized
ucugaauuuaaugaguucacugu

SEQ ID NO: 3317 - RNA, 23 nt, artificial
  Completely synthesized
uccaaugcuuuuuaaaguuucgu

SEQ ID NO: 3318 - RNA, 23 nt, artificial
  Completely synthesized
aggagcuuuuaguauaauaguac

SEQ ID NO: 3319 - RNA, 23 nt, artificial
  Completely synthesized
acagggagguuaaugauuuuuuc

SEQ ID NO: 3320 - RNA, 23 nt, artificial
  Completely synthesized
agguuaaugauuuuuucuacagg

SEQ ID NO: 3321 - RNA, 23 nt, artificial
  Completely synthesized
ugaggguauagaugaguaaaaau

SEQ ID NO: 3322 - RNA, 23 nt, artificial
  Completely synthesized
cuaguucuacuauauuuuccagu

SEQ ID NO: 3323 - RNA, 23 nt, artificial
  Completely synthesized
uggagagcuuuugcccuaaguuc

SEQ ID NO: 3324 - RNA, 23 nt, artificial
  Completely synthesized
uacaggcaauucuuucucuggug

SEQ ID NO: 3325 - RNA, 23 nt, artificial
  Completely synthesized
ccaaaagcugcaugcagucauca

SEQ ID NO: 3326 - RNA, 23 nt, artificial
  Completely synthesized
uugcugcagggaguauucacuag

SEQ ID NO: 3327 - RNA, 23 nt, artificial
  Completely synthesized
ugcugaaaacuucgagauauaag

SEQ ID NO: 3328 - RNA, 23 nt, artificial
  Completely synthesized
ugaccgggaauaucaggaacaag

SEQ ID NO: 3329 - RNA, 23 nt, artificial
  Completely synthesized
aucaggaacaagugacugaaacg

SEQ ID NO: 3330 - RNA, 23 nt, artificial
  Completely synthesized
acugagcgaaaaaggcuuucucu

SEQ ID NO: 3331 - RNA, 23 nt, artificial
  Completely synthesized
ugagcgaaaaaggcuuucucuug

SEQ ID NO: 3332 - RNA, 23 nt, artificial
  Completely synthesized
uugcuccuuuuggaguuguucuu

SEQ ID NO: 3333 - RNA, 23 nt, artificial
  Completely synthesized
ugaacugcucuuuggacaucauu

SEQ ID NO: 3334 - RNA, 23 nt, artificial
  Completely synthesized
ucagaaucacugaggccaaguag

SEQ ID NO: 3335 - RNA, 23 nt, artificial
  Completely synthesized
aaagcauuaagaaaauguggacu

SEQ ID NO: 3336 - RNA, 23 nt, artificial
  Completely synthesized
ucaggugacugagccugauuagu

SEQ ID NO: 3337 - RNA, 23 nt, artificial
  Completely synthesized
aagaauguacugguguuuuagga

SEQ ID NO: 3338 - RNA, 23 nt, artificial
  Completely synthesized
ugugucuccauagcuggaagauu

SEQ ID NO: 3339 - RNA, 23 nt, artificial
  Completely synthesized
auggcuuaaaguagcaggugagg

SEQ ID NO: 3340 - RNA, 23 nt, artificial
  Completely synthesized
caugcagucaucaaaguacaaag

SEQ ID NO: 3341 - RNA, 23 nt, artificial
  Completely synthesized
augugggcaaccugggaguaguu

SEQ ID NO: 3342 - RNA, 23 nt, artificial
  Completely synthesized
uguccuaagaaauuguuuacagu

SEQ ID NO: 3343 - RNA, 23 nt, artificial
  Completely synthesized
cucuaguucuacuauauuuucca

SEQ ID NO: 3344 - RNA, 23 nt, artificial
  Completely synthesized
agaagaauguacugguguuuuag

SEQ ID NO: 3345 - RNA, 23 nt, artificial
  Completely synthesized
acugaggccaaguagugugucuc

SEQ ID NO: 3346 - RNA, 23 nt, artificial
  Completely synthesized
agugugucuccauagcuggaaga

SEQ ID NO: 3347 - RNA, 23 nt, artificial
  Completely synthesized
agggcaugcuguugcugauacug

SEQ ID NO: 3348 - RNA, 23 nt, artificial
  Completely synthesized
acugggcucagcuaugaaagcag

SEQ ID NO: 3349 - RNA, 23 nt, artificial
  Completely synthesized
ucaaccagcuugucauuuucaau

SEQ ID NO: 3350 - RNA, 23 nt, artificial
  Completely synthesized
ccagcuugucauuuucaauauua

SEQ ID NO: 3351 - RNA, 23 nt, artificial
  Completely synthesized
cuccaaaguaugucaaucaaauc

SEQ ID NO: 3352 - RNA, 23 nt, artificial
  Completely synthesized
ugcagucaucaaaguacaaagca

SEQ ID NO: 3353 - RNA, 23 nt, artificial
  Completely synthesized
aaugugggcaaccugggaguagu

SEQ ID NO: 3354 - RNA, 23 nt, artificial
  Completely synthesized
cuccaaugcuuuuuaaaguuucg

SEQ ID NO: 3355 - RNA, 23 nt, artificial
  Completely synthesized
ccuacguauaucccgaauuaaug

SEQ ID NO: 3356 - RNA, 23 nt, artificial
  Completely synthesized
ugaagucaacaacagggagguua

SEQ ID NO: 3357 - RNA, 23 nt, artificial
  Completely synthesized
agagcuuuugcccuaaguucauc

SEQ ID NO: 3358 - RNA, 23 nt, artificial
  Completely synthesized
uuccgucgcugacugaagucaaa

SEQ ID NO: 3359 - RNA, 23 nt, artificial
  Completely synthesized
uccgucgcugacugaagucaaau

SEQ ID NO: 3360 - RNA, 23 nt, artificial
  Completely synthesized
gucgcugacugaagucaaauacu

SEQ ID NO: 3361 - RNA, 23 nt, artificial
  Completely synthesized
agggugguuuugguugaaagcuu

SEQ ID NO: 3362 - RNA, 23 nt, artificial
  Completely synthesized
gucucaaccagcuugucauuuuc

SEQ ID NO: 3363 - RNA, 23 nt, artificial
  Completely synthesized
aaccugggaguaguuggcagauc

SEQ ID NO: 3364 - RNA, 23 nt, artificial
  Completely synthesized
uagcccaaaugguguccuaagaa

SEQ ID NO: 3365 - RNA, 23 nt, artificial
  Completely synthesized
uacaguuaaagugaaacuacuga

SEQ ID NO: 3366 - RNA, 23 nt, artificial
  Completely synthesized
gggugguuuugguugaaagcuuu

SEQ ID NO: 3367 - RNA, 23 nt, artificial
  Completely synthesized
gcuaccugagcaacagaaguuuc

SEQ ID NO: 3368 - RNA, 23 nt, artificial
  Completely synthesized
ucaggaacaagugacugaaacgu

SEQ ID NO: 3369 - RNA, 23 nt, artificial
  Completely synthesized
cugagcgaaaaaggcuuucucuu

SEQ ID NO: 3370 - RNA, 23 nt, artificial
  Completely synthesized
uggcuaugauuuugcauagaauu

SEQ ID NO: 3371 - RNA, 23 nt, artificial
  Completely synthesized
ugaggccaaguagugugucucca

SEQ ID NO: 3372 - RNA, 23 nt, artificial
  Completely synthesized
aagacacuguaacucaggaaugg

SEQ ID NO: 3373 - RNA, 23 nt, artificial
  Completely synthesized
uagccagaugucauaucaucaua

SEQ ID NO: 3374 - RNA, 23 nt, artificial
  Completely synthesized
uccuacguauaucccgaauuaau

SEQ ID NO: 3375 - RNA, 23 nt, artificial
  Completely synthesized
augagccuccaagcggcuugaau

SEQ ID NO: 3376 - RNA, 23 nt, artificial
  Completely synthesized
gugucuccauagcuggaagauuc

SEQ ID NO: 3377 - RNA, 23 nt, artificial
  Completely synthesized
ugucuccauagcuggaagauucc

SEQ ID NO: 3378 - RNA, 23 nt, artificial
  Completely synthesized
ugggcccauuuagaaguucagag

SEQ ID NO: 3379 - RNA, 23 nt, artificial
  Completely synthesized
ugggagaaauucaccugucucuu

SEQ ID NO: 3380 - RNA, 23 nt, artificial
  Completely synthesized
guuuacaguuaaagugaaacuac

SEQ ID NO: 3381 - RNA, 23 nt, artificial
  Completely synthesized
aaaggucaaauccuccuaaaucu

SEQ ID NO: 3382 - RNA, 23 nt, artificial
  Completely synthesized
ugcagggaguauucacuaggaga

SEQ ID NO: 3383 - RNA, 23 nt, artificial
  Completely synthesized
ugcugaguuguuuuuucaguagg

SEQ ID NO: 3384 - RNA, 23 nt, artificial
  Completely synthesized
aacagggagguuaaugauuuuuu

SEQ ID NO: 3385 - RNA, 23 nt, artificial
  Completely synthesized
cgucgcugacugaagucaaauac

SEQ ID NO: 3386 - RNA, 23 nt, artificial
  Completely synthesized
aacgggaaugucugcgccaaaag

SEQ ID NO: 3387 - RNA, 23 nt, artificial
  Completely synthesized
guaacugagcgaaaaaggcuuuc

SEQ ID NO: 3388 - RNA, 23 nt, artificial
  Completely synthesized
agaaacuagcccaaauggugucc

SEQ ID NO: 3389 - RNA, 23 nt, artificial
  Completely synthesized
ugagcuucauugaacugcucuuu

SEQ ID NO: 3390 - RNA, 23 nt, artificial
  Completely synthesized
cucucgaugugaccgggaauauc

SEQ ID NO: 3391 - RNA, 23 nt, artificial
  Completely synthesized
gacugaaacguagccgaagaaac

SEQ ID NO: 3392 - RNA, 23 nt, artificial
  Completely synthesized
aacguagccgaagaaaccucauu

SEQ ID NO: 3393 - RNA, 23 nt, artificial
  Completely synthesized
uacaaagcaucugauuugggaau

SEQ ID NO: 3394 - RNA, 23 nt, artificial
  Completely synthesized
uacugggcucagcuaugaaagca

SEQ ID NO: 3395 - RNA, 23 nt, artificial
  Completely synthesized
aacagaaguuucaggugacugag

SEQ ID NO: 3396 - RNA, 23 nt, artificial
  Completely synthesized
aaaagcugcaugcagucaucaaa

SEQ ID NO: 3397 - RNA, 23 nt, artificial
  Completely synthesized
augcugaaaacuucgagauauaa

SEQ ID NO: 3398 - RNA, 23 nt, artificial
  Completely synthesized
aagucaaauacuucucgacuuac

SEQ ID NO: 3399 - RNA, 23 nt, artificial
  Completely synthesized
agaaguucagagagugaauggcu

SEQ ID NO: 3400 - RNA, 23 nt, artificial
  Completely synthesized
cuguguugacuguggcaucugaa

SEQ ID NO: 3401 - RNA, 23 nt, artificial
  Completely synthesized
agaggaugcugcugaaggaaucc

SEQ ID NO: 3402 - RNA, 23 nt, artificial
  Completely synthesized
gaggguauagaugaguaaaaaug

SEQ ID NO: 3403 - RNA, 23 nt, artificial
  Completely synthesized
aaacuagcccaaaugguguccua

SEQ ID NO: 3404 - RNA, 23 nt, artificial
  Completely synthesized
cuugcuccuuuuggaguuguucu

SEQ ID NO: 3405 - RNA, 23 nt, artificial
  Completely synthesized
guguguucucacauugggcauca

SEQ ID NO: 3406 - RNA, 23 nt, artificial
  Completely synthesized
gcuaugaaagcagaauaaaauuc

SEQ ID NO: 3407 - RNA, 23 nt, artificial
  Completely synthesized
gagaggaugcugcugaaggaauc

SEQ ID NO: 3408 - RNA, 23 nt, artificial
  Completely synthesized
guaacucaggaauggauaauagc

SEQ ID NO: 3409 - RNA, 23 nt, artificial
  Completely synthesized
gagcgaaaaaggcuuucucuugc

SEQ ID NO: 3410 - RNA, 23 nt, artificial
  Completely synthesized
gcuccuuuuggaguuguucuugu

SEQ ID NO: 3411 - RNA, 23 nt, artificial
  Completely synthesized
uggacaucauuucguugaaguca

SEQ ID NO: 3412 - RNA, 23 nt, artificial
  Completely synthesized
cagggaaugggauauggagagcu

SEQ ID NO: 3413 - RNA, 23 nt, artificial
  Completely synthesized
ccuccaagcggcuugaauguuug

SEQ ID NO: 3414 - RNA, 23 nt, artificial
  Completely synthesized
ugaccaggacuuacaggcaauuc

SEQ ID NO: 3415 - RNA, 23 nt, artificial
  Completely synthesized
gaaacaucaaugggcccauuuag

SEQ ID NO: 3416 - RNA, 23 nt, artificial
  Completely synthesized
gaaagcagaauaaaauucaucac

SEQ ID NO: 3417 - RNA, 23 nt, artificial
  Completely synthesized
ugacugagccugauuaguagcaa

SEQ ID NO: 3418 - RNA, 23 nt, artificial
  Completely synthesized
gaaacuagcccaaaugguguccu

SEQ ID NO: 3419 - RNA, 23 nt, artificial
  Completely synthesized
acuagcccaaaugguguccuaag

SEQ ID NO: 3420 - RNA, 23 nt, artificial
  Completely synthesized
agugaaacuacugauucaacaua

SEQ ID NO: 3421 - RNA, 23 nt, artificial
  Completely synthesized
gucaaauccuccuaaaucuaguu

SEQ ID NO: 3422 - RNA, 23 nt, artificial
  Completely synthesized
gucauuuucuccuuuuucuuuga

SEQ ID NO: 3423 - RNA, 23 nt, artificial
  Completely synthesized
cuccuuuuucuuugagcaauuuu

SEQ ID NO: 3424 - RNA, 23 nt, artificial
  Completely synthesized
auggagagcuuuugcccuaaguu

SEQ ID NO: 3425 - RNA, 23 nt, artificial
  Completely synthesized
acaggcaauucuuucucuggugu

SEQ ID NO: 3426 - RNA, 23 nt, artificial
  Completely synthesized
ggcccauuuagaaguucagagag

SEQ ID NO: 3427 - RNA, 23 nt, artificial
  Completely synthesized
caucugaauuuaaugaguucacu

SEQ ID NO: 3428 - RNA, 23 nt, artificial
  Completely synthesized
aacuagcccaaaugguguccuaa

SEQ ID NO: 3429 - RNA, 23 nt, artificial
  Completely synthesized
guguccuaagaaauuguuuacag

SEQ ID NO: 3430 - RNA, 23 nt, artificial
  Completely synthesized
caaccaaaaccacccugaaagca

SEQ ID NO: 3431 - RNA, 23 nt, artificial
  Completely synthesized
ucaaccaaaaccacccugaaagc

SEQ ID NO: 3432 - RNA, 23 nt, artificial
  Completely synthesized
uucaaccaaaaccacccugaaag

SEQ ID NO: 3433 - RNA, 23 nt, artificial
  Completely synthesized
uuucaaccaaaaccacccugaaa

SEQ ID NO: 3434 - RNA, 23 nt, artificial
  Completely synthesized
cuuucaaccaaaaccacccugaa

SEQ ID NO: 3435 - RNA, 23 nt, artificial
  Completely synthesized
caaacagaaugguccuaaaacac

SEQ ID NO: 3436 - RNA, 23 nt, artificial
  Completely synthesized
ucaaacagaaugguccuaaaaca

SEQ ID NO: 3437 - RNA, 23 nt, artificial
  Completely synthesized
gucaaacagaaugguccuaaaac

SEQ ID NO: 3438 - RNA, 23 nt, artificial
  Completely synthesized
ugucaaacagaaugguccuaaaa

SEQ ID NO: 3439 - RNA, 23 nt, artificial
  Completely synthesized
gugucaaacagaaugguccuaaa

SEQ ID NO: 3440 - RNA, 23 nt, artificial
  Completely synthesized
cagugauucugaaguggaagagc

SEQ ID NO: 3441 - RNA, 23 nt, artificial
  Completely synthesized
ucagugauucugaaguggaagag

SEQ ID NO: 3442 - RNA, 23 nt, artificial
  Completely synthesized
cucagugauucugaaguggaaga

SEQ ID NO: 3443 - RNA, 23 nt, artificial
  Completely synthesized
ccucagugauucugaaguggaag

SEQ ID NO: 3444 - RNA, 23 nt, artificial
  Completely synthesized
gccucagugauucugaaguggaa

SEQ ID NO: 3445 - RNA, 23 nt, artificial
  Completely synthesized
gcagaaaaagaaaacuggaaaau

SEQ ID NO: 3446 - RNA, 23 nt, artificial
  Completely synthesized
ugcagaaaaagaaaacuggaaaa

SEQ ID NO: 3447 - RNA, 23 nt, artificial
  Completely synthesized
uugcagaaaaagaaaacuggaaa

SEQ ID NO: 3448 - RNA, 23 nt, artificial
  Completely synthesized
auugcagaaaaagaaaacuggaa

SEQ ID NO: 3449 - RNA, 23 nt, artificial
  Completely synthesized
aauugcagaaaaagaaaacugga

SEQ ID NO: 3450 - RNA, 23 nt, artificial
  Completely synthesized
ccaaaaggagcaagagaaagccu

SEQ ID NO: 3451 - RNA, 23 nt, artificial
  Completely synthesized
uccaaaaggagcaagagaaagcc

SEQ ID NO: 3452 - RNA, 23 nt, artificial
  Completely synthesized
cuccaaaaggagcaagagaaagc

SEQ ID NO: 3453 - RNA, 23 nt, artificial
  Completely synthesized
acuccaaaaggagcaagagaaag

SEQ ID NO: 3454 - RNA, 23 nt, artificial
  Completely synthesized
aacuccaaaaggagcaagagaaa

SEQ ID NO: 3455 - RNA, 23 nt, artificial
  Completely synthesized
cagaaaaagaaaacuggaaaaua

SEQ ID NO: 3456 - RNA, 23 nt, artificial
  Completely synthesized
cacagauuuuggugaugaauuuu

SEQ ID NO: 3457 - RNA, 23 nt, artificial
  Completely synthesized
acacagauuuuggugaugaauuu

SEQ ID NO: 3458 - RNA, 23 nt, artificial
  Completely synthesized
aacacagauuuuggugaugaauu

SEQ ID NO: 3459 - RNA, 23 nt, artificial
  Completely synthesized
caacacagauuuuggugaugaau

SEQ ID NO: 3460 - RNA, 23 nt, artificial
  Completely synthesized
ucaacacagauuuuggugaugaa

SEQ ID NO: 3461 - RNA, 23 nt, artificial
  Completely synthesized
auugcaaaacuaaccacuaugua

SEQ ID NO: 3462 - RNA, 23 nt, artificial
  Completely synthesized
uauugcaaaacuaaccacuaugu

SEQ ID NO: 3463 - RNA, 23 nt, artificial
  Completely synthesized
uuauugcaaaacuaaccacuaug

SEQ ID NO: 3464 - RNA, 23 nt, artificial
  Completely synthesized
auuauugcaaaacuaaccacuau

SEQ ID NO: 3465 - RNA, 23 nt, artificial
  Completely synthesized
aauuauugcaaaacuaaccacua

SEQ ID NO: 3466 - RNA, 23 nt, artificial
  Completely synthesized
gcucagaauugcagaaaaagaaa

SEQ ID NO: 3467 - RNA, 23 nt, artificial
  Completely synthesized
ugcucagaauugcagaaaaagaa

SEQ ID NO: 3468 - RNA, 23 nt, artificial
  Completely synthesized
cugcucagaauugcagaaaaaga

SEQ ID NO: 3469 - RNA, 23 nt, artificial
  Completely synthesized
gcugcucagaauugcagaaaaag

SEQ ID NO: 3470 - RNA, 23 nt, artificial
  Completely synthesized
ggcugcucagaauugcagaaaaa

SEQ ID NO: 3471 - RNA, 23 nt, artificial
  Completely synthesized
cuggaagugucaaacagaauggu

SEQ ID NO: 3472 - RNA, 23 nt, artificial
  Completely synthesized
ccuggaagugucaaacagaaugg

SEQ ID NO: 3473 - RNA, 23 nt, artificial
  Completely synthesized
cccuggaagugucaaacagaaug

SEQ ID NO: 3474 - RNA, 23 nt, artificial
  Completely synthesized
ccccuggaagugucaaacagaau

SEQ ID NO: 3475 - RNA, 23 nt, artificial
  Completely synthesized
gccccuggaagugucaaacagaa

SEQ ID NO: 3476 - RNA, 23 nt, artificial
  Completely synthesized
acaucuggcuaaaaagaaauuau

SEQ ID NO: 3477 - RNA, 23 nt, artificial
  Completely synthesized
gacaucuggcuaaaaagaaauua

SEQ ID NO: 3478 - RNA, 23 nt, artificial
  Completely synthesized
ugacaucuggcuaaaaagaaauu

SEQ ID NO: 3479 - RNA, 23 nt, artificial
  Completely synthesized
augacaucuggcuaaaaagaaau

SEQ ID NO: 3480 - RNA, 23 nt, artificial
  Completely synthesized
uaugacaucuggcuaaaaagaaa

SEQ ID NO: 3481 - RNA, 23 nt, artificial
  Completely synthesized
gcuggaaaaacagaaaaaacuug

SEQ ID NO: 3482 - RNA, 23 nt, artificial
  Completely synthesized
agcuggaaaaacagaaaaaacuu

SEQ ID NO: 3483 - RNA, 23 nt, artificial
  Completely synthesized
gagcuggaaaaacagaaaaaacu

SEQ ID NO: 3484 - RNA, 23 nt, artificial
  Completely synthesized
ugagcuggaaaaacagaaaaaac

SEQ ID NO: 3485 - RNA, 23 nt, artificial
  Completely synthesized
augagcuggaaaaacagaaaaaa

SEQ ID NO: 3486 - RNA, 23 nt, artificial
  Completely synthesized
cagucuucauugcuacuaaucag

SEQ ID NO: 3487 - RNA, 23 nt, artificial
  Completely synthesized
ccagucuucauugcuacuaauca

SEQ ID NO: 3488 - RNA, 23 nt, artificial
  Completely synthesized
cccagucuucauugcuacuaauc

SEQ ID NO: 3489 - RNA, 23 nt, artificial
  Completely synthesized
gcccagucuucauugcuacuaau

SEQ ID NO: 3490 - RNA, 23 nt, artificial
  Completely synthesized
agcccagucuucauugcuacuaa

SEQ ID NO: 3491 - RNA, 23 nt, artificial
  Completely synthesized
gaagccagauguuaagaaaaacu

SEQ ID NO: 3492 - RNA, 23 nt, artificial
  Completely synthesized
agaagccagauguuaagaaaaac

SEQ ID NO: 3493 - RNA, 23 nt, artificial
  Completely synthesized
aagaagccagauguuaagaaaaa

SEQ ID NO: 3494 - RNA, 23 nt, artificial
  Completely synthesized
uaagaagccagauguuaagaaaa

SEQ ID NO: 3495 - RNA, 23 nt, artificial
  Completely synthesized
guaagaagccagauguuaagaaa

SEQ ID NO: 3496 - RNA, 23 nt, artificial
  Completely synthesized
agaugaagagacaggugaauuuc

SEQ ID NO: 3497 - RNA, 23 nt, artificial
  Completely synthesized
uagaugaagagacaggugaauuu

SEQ ID NO: 3498 - RNA, 23 nt, artificial
  Completely synthesized
cuagaugaagagacaggugaauu

SEQ ID NO: 3499 - RNA, 23 nt, artificial
  Completely synthesized
acuagaugaagagacaggugaau

SEQ ID NO: 3500 - RNA, 23 nt, artificial
  Completely synthesized
aacuagaugaagagacaggugaa

SEQ ID NO: 3501 - RNA, 23 nt, artificial
  Completely synthesized
uaugagcuggaaaaacagaaaaa

SEQ ID NO: 3502 - RNA, 23 nt, artificial
  Completely synthesized
cccugaaagcacagcagaauuca

SEQ ID NO: 3503 - RNA, 23 nt, artificial
  Completely synthesized
acccugaaagcacagcagaauuc

SEQ ID NO: 3504 - RNA, 23 nt, artificial
  Completely synthesized
cacccugaaagcacagcagaauu

SEQ ID NO: 3505 - RNA, 23 nt, artificial
  Completely synthesized
ccacccugaaagcacagcagaau

SEQ ID NO: 3506 - RNA, 23 nt, artificial
  Completely synthesized
accacccugaaagcacagcagaa

SEQ ID NO: 3507 - RNA, 23 nt, artificial
  Completely synthesized
ggagugucaguauguugaaucag

SEQ ID NO: 3508 - RNA, 23 nt, artificial
  Completely synthesized
uggagugucaguauguugaauca

SEQ ID NO: 3509 - RNA, 23 nt, artificial
  Completely synthesized
uuggagugucaguauguugaauc

SEQ ID NO: 3510 - RNA, 23 nt, artificial
  Completely synthesized
auuggagugucaguauguugaau

SEQ ID NO: 3511 - RNA, 23 nt, artificial
  Completely synthesized
cauuggagugucaguauguugaa

SEQ ID NO: 3512 - RNA, 23 nt, artificial
  Completely synthesized
cagaauugcagaaaaagaaaacu

SEQ ID NO: 3513 - RNA, 23 nt, artificial
  Completely synthesized
ucagaauugcagaaaaagaaaac

SEQ ID NO: 3514 - RNA, 23 nt, artificial
  Completely synthesized
cucagaauugcagaaaaagaaaa

SEQ ID NO: 3515 - RNA, 23 nt, artificial
  Completely synthesized
ggguaagaauaaaguggcugcuc

SEQ ID NO: 3516 - RNA, 23 nt, artificial
  Completely synthesized
gggguaagaauaaaguggcugcu

SEQ ID NO: 3517 - RNA, 23 nt, artificial
  Completely synthesized
agggguaagaauaaaguggcugc

SEQ ID NO: 3518 - RNA, 23 nt, artificial
  Completely synthesized
gagggguaagaauaaaguggcug

SEQ ID NO: 3519 - RNA, 23 nt, artificial
  Completely synthesized
ggagggguaagaauaaaguggcu

SEQ ID NO: 3520 - RNA, 23 nt, artificial
  Completely synthesized
aguaagaagccagauguuaagaa

SEQ ID NO: 3521 - RNA, 23 nt, artificial
  Completely synthesized
aaguaagaagccagauguuaaga

SEQ ID NO: 3522 - RNA, 23 nt, artificial
  Completely synthesized
aaaguaagaagccagauguuaag

SEQ ID NO: 3523 - RNA, 23 nt, artificial
  Completely synthesized
aaaaguaagaagccagauguuaa

SEQ ID NO: 3524 - RNA, 23 nt, artificial
  Completely synthesized
acuugaaaaggaaagacaagaac

SEQ ID NO: 3525 - RNA, 23 nt, artificial
  Completely synthesized
aacuugaaaaggaaagacaagaa

SEQ ID NO: 3526 - RNA, 23 nt, artificial
  Completely synthesized
aaacuugaaaaggaaagacaaga

SEQ ID NO: 3527 - RNA, 23 nt, artificial
  Completely synthesized
aaaacuugaaaaggaaagacaag

SEQ ID NO: 3528 - RNA, 23 nt, artificial
  Completely synthesized
aaaaacuugaaaaggaaagacaa

SEQ ID NO: 3529 - RNA, 23 nt, artificial
  Completely synthesized
gcaguucaaugaagcucaacuug

SEQ ID NO: 3530 - RNA, 23 nt, artificial
  Completely synthesized
agcaguucaaugaagcucaacuu

SEQ ID NO: 3531 - RNA, 23 nt, artificial
  Completely synthesized
gagcaguucaaugaagcucaacu

SEQ ID NO: 3532 - RNA, 23 nt, artificial
  Completely synthesized
agagcaguucaaugaagcucaac

SEQ ID NO: 3533 - RNA, 23 nt, artificial
  Completely synthesized
aagagcaguucaaugaagcucaa

SEQ ID NO: 3534 - RNA, 23 nt, artificial
  Completely synthesized
agaugaacuuagggcaaaagcuc

SEQ ID NO: 3535 - RNA, 23 nt, artificial
  Completely synthesized
gagaugaacuuagggcaaaagcu

SEQ ID NO: 3536 - RNA, 23 nt, artificial
  Completely synthesized
agagaugaacuuagggcaaaagc

SEQ ID NO: 3537 - RNA, 23 nt, artificial
  Completely synthesized
aagagaugaacuuagggcaaaag

SEQ ID NO: 3538 - RNA, 23 nt, artificial
  Completely synthesized
caagagaugaacuuagggcaaaa

SEQ ID NO: 3539 - RNA, 23 nt, artificial
  Completely synthesized
gaaagaguaugagcuggaaaaac

SEQ ID NO: 3540 - RNA, 23 nt, artificial
  Completely synthesized
ggaaagaguaugagcuggaaaaa

SEQ ID NO: 3541 - RNA, 23 nt, artificial
  Completely synthesized
cggaaagaguaugagcuggaaaa

SEQ ID NO: 3542 - RNA, 23 nt, artificial
  Completely synthesized
acggaaagaguaugagcuggaaa

SEQ ID NO: 3543 - RNA, 23 nt, artificial
  Completely synthesized
gacggaaagaguaugagcuggaa

SEQ ID NO: 3544 - RNA, 23 nt, artificial
  Completely synthesized
cauugauguuucugaucuaucac

SEQ ID NO: 3545 - RNA, 23 nt, artificial
  Completely synthesized
ccauugauguuucugaucuauca

SEQ ID NO: 3546 - RNA, 23 nt, artificial
  Completely synthesized
cccauugauguuucugaucuauc

SEQ ID NO: 3547 - RNA, 23 nt, artificial
  Completely synthesized
gcccauugauguuucugaucuau

SEQ ID NO: 3548 - RNA, 23 nt, artificial
  Completely synthesized
ggcccauugauguuucugaucua

SEQ ID NO: 3549 - RNA, 23 nt, artificial
  Completely synthesized
gcaacaggacauugagcaaguuu

SEQ ID NO: 3550 - RNA, 23 nt, artificial
  Completely synthesized
ugcaacaggacauugagcaaguu

SEQ ID NO: 3551 - RNA, 23 nt, artificial
  Completely synthesized
augcaacaggacauugagcaagu

SEQ ID NO: 3552 - RNA, 23 nt, artificial
  Completely synthesized
uaugcaacaggacauugagcaag

SEQ ID NO: 3553 - RNA, 23 nt, artificial
  Completely synthesized
guaugcaacaggacauugagcaa

SEQ ID NO: 3554 - RNA, 23 nt, artificial
  Completely synthesized
caaaacuaaccacuauguacuuu

SEQ ID NO: 3555 - RNA, 23 nt, artificial
  Completely synthesized
gcaaaacuaaccacuauguacuu

SEQ ID NO: 3556 - RNA, 23 nt, artificial
  Completely synthesized
ugcaaaacuaaccacuauguacu

SEQ ID NO: 3557 - RNA, 23 nt, artificial
  Completely synthesized
uugcaaaacuaaccacuauguac

SEQ ID NO: 3558 - RNA, 23 nt, artificial
  Completely synthesized
gugaaaugcucauacuuuauaag

SEQ ID NO: 3559 - RNA, 23 nt, artificial
  Completely synthesized
ugugaaaugcucauacuuuauaa

SEQ ID NO: 3560 - RNA, 23 nt, artificial
  Completely synthesized
augugaaaugcucauacuuuaua

SEQ ID NO: 3561 - RNA, 23 nt, artificial
  Completely synthesized
gaugugaaaugcucauacuuuau

SEQ ID NO: 3562 - RNA, 23 nt, artificial
  Completely synthesized
ugaugugaaaugcucauacuuua

SEQ ID NO: 3563 - RNA, 23 nt, artificial
  Completely synthesized
caaagagcaguucaaugaagcuc

SEQ ID NO: 3564 - RNA, 23 nt, artificial
  Completely synthesized
ccaaagagcaguucaaugaagcu

SEQ ID NO: 3565 - RNA, 23 nt, artificial
  Completely synthesized
uccaaagagcaguucaaugaagc

SEQ ID NO: 3566 - RNA, 23 nt, artificial
  Completely synthesized
guccaaagagcaguucaaugaag

SEQ ID NO: 3567 - RNA, 23 nt, artificial
  Completely synthesized
uguccaaagagcaguucaaugaa

SEQ ID NO: 3568 - RNA, 23 nt, artificial
  Completely synthesized
gagaaagaauugccuguaagucc

SEQ ID NO: 3569 - RNA, 23 nt, artificial
  Completely synthesized
agagaaagaauugccuguaaguc

SEQ ID NO: 3570 - RNA, 23 nt, artificial
  Completely synthesized
cagagaaagaauugccuguaagu

SEQ ID NO: 3571 - RNA, 23 nt, artificial
  Completely synthesized
ccagagaaagaauugccuguaag

SEQ ID NO: 3572 - RNA, 23 nt, artificial
  Completely synthesized
accagagaaagaauugccuguaa

SEQ ID NO: 3573 - RNA, 23 nt, artificial
  Completely synthesized
ucacgugcaugaugcccaaugug

SEQ ID NO: 3574 - RNA, 23 nt, artificial
  Completely synthesized
cucacgugcaugaugcccaaugu

SEQ ID NO: 3575 - RNA, 23 nt, artificial
  Completely synthesized
acucacgugcaugaugcccaaug

SEQ ID NO: 3576 - RNA, 23 nt, artificial
  Completely synthesized
cacucacgugcaugaugcccaau

SEQ ID NO: 3577 - RNA, 23 nt, artificial
  Completely synthesized
gcacucacgugcaugaugcccaa

SEQ ID NO: 3578 - RNA, 23 nt, artificial
  Completely synthesized
aaccaaaaccacccugaaagcac

SEQ ID NO: 3579 - RNA, 23 nt, artificial
  Completely synthesized
ugccccuggaagugucaaacaga

SEQ ID NO: 3580 - RNA, 23 nt, artificial
  Completely synthesized
gacagaaguugacaauuaucauu

SEQ ID NO: 3581 - RNA, 23 nt, artificial
  Completely synthesized
ugacagaaguugacaauuaucau

SEQ ID NO: 3582 - RNA, 23 nt, artificial
  Completely synthesized
cugacagaaguugacaauuauca

SEQ ID NO: 3583 - RNA, 23 nt, artificial
  Completely synthesized
acugacagaaguugacaauuauc

SEQ ID NO: 3584 - RNA, 23 nt, artificial
  Completely synthesized
aacugacagaaguugacaauuau

SEQ ID NO: 3585 - RNA, 23 nt, artificial
  Completely synthesized
ugauuuagacgguaugcaacagg

SEQ ID NO: 3586 - RNA, 23 nt, artificial
  Completely synthesized
uugauuuagacgguaugcaacag

SEQ ID NO: 3587 - RNA, 23 nt, artificial
  Completely synthesized
guugauuuagacgguaugcaaca

SEQ ID NO: 3588 - RNA, 23 nt, artificial
  Completely synthesized
uguugauuuagacgguaugcaac

SEQ ID NO: 3589 - RNA, 23 nt, artificial
  Completely synthesized
cuguugauuuagacgguaugcaa

SEQ ID NO: 3590 - RNA, 23 nt, artificial
  Completely synthesized
gcuacgugaugaagauggaaaac

SEQ ID NO: 3591 - RNA, 23 nt, artificial
  Completely synthesized
ugcuacgugaugaagauggaaaa

SEQ ID NO: 3592 - RNA, 23 nt, artificial
  Completely synthesized
augcuacgugaugaagauggaaa

SEQ ID NO: 3593 - RNA, 23 nt, artificial
  Completely synthesized
caugcuacgugaugaagauggaa

SEQ ID NO: 3594 - RNA, 23 nt, artificial
  Completely synthesized
gcaugcuacgugaugaagaugga

SEQ ID NO: 3595 - RNA, 23 nt, artificial
  Completely synthesized
cccucaccugcuacuuuaagcca

SEQ ID NO: 3596 - RNA, 23 nt, artificial
  Completely synthesized
gcccucaccugcuacuuuaagcc

SEQ ID NO: 3597 - RNA, 23 nt, artificial
  Completely synthesized
ugcccucaccugcuacuuuaagc

SEQ ID NO: 3598 - RNA, 23 nt, artificial
  Completely synthesized
augcccucaccugcuacuuuaag

SEQ ID NO: 3599 - RNA, 23 nt, artificial
  Completely synthesized
caugcccucaccugcuacuuuaa

SEQ ID NO: 3600 - RNA, 23 nt, artificial
  Completely synthesized
cccacauucccaaaucagaugcu

SEQ ID NO: 3601 - RNA, 23 nt, artificial
  Completely synthesized
gcccacauucccaaaucagaugc

SEQ ID NO: 3602 - RNA, 23 nt, artificial
  Completely synthesized
ugcccacauucccaaaucagaug

SEQ ID NO: 3603 - RNA, 23 nt, artificial
  Completely synthesized
uugcccacauucccaaaucagau

SEQ ID NO: 3604 - RNA, 23 nt, artificial
  Completely synthesized
guugcccacauucccaaaucaga

SEQ ID NO: 3605 - RNA, 23 nt, artificial
  Completely synthesized
agccaaaacuaguauagaaaaua

SEQ ID NO: 3606 - RNA, 23 nt, artificial
  Completely synthesized
uagccaaaacuaguauagaaaau

SEQ ID NO: 3607 - RNA, 23 nt, artificial
  Completely synthesized
auagccaaaacuaguauagaaaa

SEQ ID NO: 3608 - RNA, 23 nt, artificial
  Completely synthesized
cauagccaaaacuaguauagaaa

SEQ ID NO: 3609 - RNA, 23 nt, artificial
  Completely synthesized
ucauagccaaaacuaguauagaa

SEQ ID NO: 3610 - RNA, 23 nt, artificial
  Completely synthesized
aagagcugguacuaauaaaggau

SEQ ID NO: 3611 - RNA, 23 nt, artificial
  Completely synthesized
uaagagcugguacuaauaaagga

SEQ ID NO: 3612 - RNA, 23 nt, artificial
  Completely synthesized
uuaagagcugguacuaauaaagg

SEQ ID NO: 3613 - RNA, 23 nt, artificial
  Completely synthesized
uuuaagagcugguacuaauaaag

SEQ ID NO: 3614 - RNA, 23 nt, artificial
  Completely synthesized
cuccuacugugaugugaaaugcu

SEQ ID NO: 3615 - RNA, 23 nt, artificial
  Completely synthesized
gcuccuacugugaugugaaaugc

SEQ ID NO: 3616 - RNA, 23 nt, artificial
  Completely synthesized
agcuccuacugugaugugaaaug

SEQ ID NO: 3617 - RNA, 23 nt, artificial
  Completely synthesized
aagcuccuacugugaugugaaau

SEQ ID NO: 3618 - RNA, 23 nt, artificial
  Completely synthesized
aaagcuccuacugugaugugaaa

SEQ ID NO: 3619 - RNA, 23 nt, artificial
  Completely synthesized
aaaagcuccuacugugaugugaa

SEQ ID NO: 3620 - RNA, 23 nt, artificial
  Completely synthesized
ccaaaaguaagaagccagauguu

SEQ ID NO: 3621 - RNA, 23 nt, artificial
  Completely synthesized
cccaaaaguaagaagccagaugu

SEQ ID NO: 3622 - RNA, 23 nt, artificial
  Completely synthesized
ucccaaaaguaagaagccagaug

SEQ ID NO: 3623 - RNA, 23 nt, artificial
  Completely synthesized
uucccaaaaguaagaagccagau

SEQ ID NO: 3624 - RNA, 23 nt, artificial
  Completely synthesized
guucccaaaaguaagaagccaga

SEQ ID NO: 3625 - RNA, 23 nt, artificial
  Completely synthesized
cagcaugcuacgugaugaagaug

SEQ ID NO: 3626 - RNA, 23 nt, artificial
  Completely synthesized
ucagcaugcuacgugaugaagau

SEQ ID NO: 3627 - RNA, 23 nt, artificial
  Completely synthesized
uucagcaugcuacgugaugaaga

SEQ ID NO: 3628 - RNA, 23 nt, artificial
  Completely synthesized
uuucagcaugcuacgugaugaag

SEQ ID NO: 3629 - RNA, 23 nt, artificial
  Completely synthesized
uuuucagcaugcuacgugaugaa

SEQ ID NO: 3630 - RNA, 23 nt, artificial
  Completely synthesized
gcucaaagaaaaaggagaaaaug

SEQ ID NO: 3631 - RNA, 23 nt, artificial
  Completely synthesized
ugcucaaagaaaaaggagaaaau

SEQ ID NO: 3632 - RNA, 23 nt, artificial
  Completely synthesized
uugcucaaagaaaaaggagaaaa

SEQ ID NO: 3633 - RNA, 23 nt, artificial
  Completely synthesized
auugcucaaagaaaaaggagaaa

SEQ ID NO: 3634 - RNA, 23 nt, artificial
  Completely synthesized
aauugcucaaagaaaaaggagaa

SEQ ID NO: 3635 - RNA, 23 nt, artificial
  Completely synthesized
gccaaaacuaguauagaaaauaa

SEQ ID NO: 3636 - RNA, 23 nt, artificial
  Completely synthesized
acgugaugaagauggaaaaccuu

SEQ ID NO: 3637 - RNA, 23 nt, artificial
  Completely synthesized
uacgugaugaagauggaaaaccu

SEQ ID NO: 3638 - RNA, 23 nt, artificial
  Completely synthesized
cuacgugaugaagauggaaaacc

SEQ ID NO: 3639 - RNA, 23 nt, artificial
  Completely synthesized
agcaugcuacgugaugaagaugg

SEQ ID NO: 3640 - RNA, 23 nt, artificial
  Completely synthesized
caacgaaaugauguccaaagagc

SEQ ID NO: 3641 - RNA, 23 nt, artificial
  Completely synthesized
ucaacgaaaugauguccaaagag

SEQ ID NO: 3642 - RNA, 23 nt, artificial
  Completely synthesized
uucaacgaaaugauguccaaaga

SEQ ID NO: 3643 - RNA, 23 nt, artificial
  Completely synthesized
cuucaacgaaaugauguccaaag

SEQ ID NO: 3644 - RNA, 23 nt, artificial
  Completely synthesized
acuucaacgaaaugauguccaaa

SEQ ID NO: 3645 - RNA, 23 nt, artificial
  Completely synthesized
gcaaagcuuucaaccaaaaccac

SEQ ID NO: 3646 - RNA, 23 nt, artificial
  Completely synthesized
ugcaaagcuuucaaccaaaacca

SEQ ID NO: 3647 - RNA, 23 nt, artificial
  Completely synthesized
uugcaaagcuuucaaccaaaacc

SEQ ID NO: 3648 - RNA, 23 nt, artificial
  Completely synthesized
uuugcaaagcuuucaaccaaaac

SEQ ID NO: 3649 - RNA, 23 nt, artificial
  Completely synthesized
cuuugcaaagcuuucaaccaaaa

SEQ ID NO: 3650 - RNA, 23 nt, artificial
  Completely synthesized
gaguuacagugucuuaauauuga

SEQ ID NO: 3651 - RNA, 23 nt, artificial
  Completely synthesized
ugaguuacagugucuuaauauug

SEQ ID NO: 3652 - RNA, 23 nt, artificial
  Completely synthesized
cugaguuacagugucuuaauauu

SEQ ID NO: 3653 - RNA, 23 nt, artificial
  Completely synthesized
ccugaguuacagugucuuaauau

SEQ ID NO: 3654 - RNA, 23 nt, artificial
  Completely synthesized
uccugaguuacagugucuuaaua

SEQ ID NO: 3655 - RNA, 23 nt, artificial
  Completely synthesized
ugggcuaguuucuguguaagugu

SEQ ID NO: 3656 - RNA, 23 nt, artificial
  Completely synthesized
uugggcuaguuucuguguaagug

SEQ ID NO: 3657 - RNA, 23 nt, artificial
  Completely synthesized
uuugggcuaguuucuguguaagu

SEQ ID NO: 3658 - RNA, 23 nt, artificial
  Completely synthesized
auuugggcuaguuucuguguaag

SEQ ID NO: 3659 - RNA, 23 nt, artificial
  Completely synthesized
cauuugggcuaguuucuguguaa

SEQ ID NO: 3660 - RNA, 23 nt, artificial
  Completely synthesized
caugguuccaaguccagaagcca

SEQ ID NO: 3661 - RNA, 23 nt, artificial
  Completely synthesized
ccaugguuccaaguccagaagcc

SEQ ID NO: 3662 - RNA, 23 nt, artificial
  Completely synthesized
accaugguuccaaguccagaagc

SEQ ID NO: 3663 - RNA, 23 nt, artificial
  Completely synthesized
uaccaugguuccaaguccagaag

SEQ ID NO: 3664 - RNA, 23 nt, artificial
  Completely synthesized
cuaccaugguuccaaguccagaa

SEQ ID NO: 3665 - RNA, 23 nt, artificial
  Completely synthesized
caggcucagucaccugaaacuuc

SEQ ID NO: 3666 - RNA, 23 nt, artificial
  Completely synthesized
ucaggcucagucaccugaaacuu

SEQ ID NO: 3667 - RNA, 23 nt, artificial
  Completely synthesized
aucaggcucagucaccugaaacu

SEQ ID NO: 3668 - RNA, 23 nt, artificial
  Completely synthesized
aaucaggcucagucaccugaaac

SEQ ID NO: 3669 - RNA, 23 nt, artificial
  Completely synthesized
uaaucaggcucagucaccugaaa

SEQ ID NO: 3670 - RNA, 23 nt, artificial
  Completely synthesized
cauggauuugauugacauacuuu

SEQ ID NO: 3671 - RNA, 23 nt, artificial
  Completely synthesized
acauggauuugauugacauacuu

SEQ ID NO: 3672 - RNA, 23 nt, artificial
  Completely synthesized
gacauggauuugauugacauacu

SEQ ID NO: 3673 - RNA, 23 nt, artificial
  Completely synthesized
ggacauggauuugauugacauac

SEQ ID NO: 3674 - RNA, 23 nt, artificial
  Completely synthesized
aggacauggauuugauugacaua

SEQ ID NO: 3675 - RNA, 23 nt, artificial
  Completely synthesized
gacuucaacgaaaugauguccaa

SEQ ID NO: 3676 - RNA, 23 nt, artificial
  Completely synthesized
cacucucugaacuucuaaauggg

SEQ ID NO: 3677 - RNA, 23 nt, artificial
  Completely synthesized
ucacucucugaacuucuaaaugg

SEQ ID NO: 3678 - RNA, 23 nt, artificial
  Completely synthesized
uucacucucugaacuucuaaaug

SEQ ID NO: 3679 - RNA, 23 nt, artificial
  Completely synthesized
auucacucucugaacuucuaaau

SEQ ID NO: 3680 - RNA, 23 nt, artificial
  Completely synthesized
cauucacucucugaacuucuaaa

SEQ ID NO: 3681 - RNA, 23 nt, artificial
  Completely synthesized
uggaguaagucgagaaguauuug

SEQ ID NO: 3682 - RNA, 23 nt, artificial
  Completely synthesized
uuggaguaagucgagaaguauuu

SEQ ID NO: 3683 - RNA, 23 nt, artificial
  Completely synthesized
cuuggaguaagucgagaaguauu

SEQ ID NO: 3684 - RNA, 23 nt, artificial
  Completely synthesized
ucuuggaguaagucgagaaguau

SEQ ID NO: 3685 - RNA, 23 nt, artificial
  Completely synthesized
aucuuggaguaagucgagaagua

SEQ ID NO: 3686 - RNA, 23 nt, artificial
  Completely synthesized
aaaggaaagacaagaacaacucc

SEQ ID NO: 3687 - RNA, 23 nt, artificial
  Completely synthesized
aaaaggaaagacaagaacaacuc

SEQ ID NO: 3688 - RNA, 23 nt, artificial
  Completely synthesized
gaaaaggaaagacaagaacaacu

SEQ ID NO: 3689 - RNA, 23 nt, artificial
  Completely synthesized
ugaaaaggaaagacaagaacaac

SEQ ID NO: 3690 - RNA, 23 nt, artificial
  Completely synthesized
uugaaaaggaaagacaagaacaa

SEQ ID NO: 3691 - RNA, 23 nt, artificial
  Completely synthesized
agaacuagagcaagauuuagauc

SEQ ID NO: 3692 - RNA, 23 nt, artificial
  Completely synthesized
uagaacuagagcaagauuuagau

SEQ ID NO: 3693 - RNA, 23 nt, artificial
  Completely synthesized
guagaacuagagcaagauuuaga

SEQ ID NO: 3694 - RNA, 23 nt, artificial
  Completely synthesized
aguagaacuagagcaagauuuag

SEQ ID NO: 3695 - RNA, 23 nt, artificial
  Completely synthesized
uaguagaacuagagcaagauuua

SEQ ID NO: 3696 - RNA, 23 nt, artificial
  Completely synthesized
guuguugacuucaacgaaaugau

SEQ ID NO: 3697 - RNA, 23 nt, artificial
  Completely synthesized
uguuguugacuucaacgaaauga

SEQ ID NO: 3698 - RNA, 23 nt, artificial
  Completely synthesized
cuguuguugacuucaacgaaaug

SEQ ID NO: 3699 - RNA, 23 nt, artificial
  Completely synthesized
ccuguuguugacuucaacgaaau

SEQ ID NO: 3700 - RNA, 23 nt, artificial
  Completely synthesized
cccuguuguugacuucaacgaaa

SEQ ID NO: 3701 - RNA, 23 nt, artificial
  Completely synthesized
acagaaugguccuaaaacaccag

SEQ ID NO: 3702 - RNA, 23 nt, artificial
  Completely synthesized
aacagaaugguccuaaaacacca

SEQ ID NO: 3703 - RNA, 23 nt, artificial
  Completely synthesized
aaacagaaugguccuaaaacacc

SEQ ID NO: 3704 - RNA, 23 nt, artificial
  Completely synthesized
aaagcacagcagaauucaaugau

SEQ ID NO: 3705 - RNA, 23 nt, artificial
  Completely synthesized
gaaagcacagcagaauucaauga

SEQ ID NO: 3706 - RNA, 23 nt, artificial
  Completely synthesized
ugaaagcacagcagaauucaaug

SEQ ID NO: 3707 - RNA, 23 nt, artificial
  Completely synthesized
cugaaagcacagcagaauucaau

SEQ ID NO: 3708 - RNA, 23 nt, artificial
  Completely synthesized
ccugaaagcacagcagaauucaa

SEQ ID NO: 3709 - RNA, 23 nt, artificial
  Completely synthesized
ugauguuucugaucuaucacuuu

SEQ ID NO: 3710 - RNA, 23 nt, artificial
  Completely synthesized
uugauguuucugaucuaucacuu

SEQ ID NO: 3711 - RNA, 23 nt, artificial
  Completely synthesized
auugauguuucugaucuaucacu

SEQ ID NO: 3712 - RNA, 23 nt, artificial
  Completely synthesized
gggcccauugauguuucugaucu

SEQ ID NO: 3713 - RNA, 23 nt, artificial
  Completely synthesized
ugggcccauugauguuucugauc

SEQ ID NO: 3714 - RNA, 23 nt, artificial
  Completely synthesized
augggcccauugauguuucugau

SEQ ID NO: 3715 - RNA, 23 nt, artificial
  Completely synthesized
agccagauguuaagaaaaacuag

SEQ ID NO: 3716 - RNA, 23 nt, artificial
  Completely synthesized
aagccagauguuaagaaaaacua

SEQ ID NO: 3717 - RNA, 23 nt, artificial
  Completely synthesized
agacaagaacaacuccaaaagga

SEQ ID NO: 3718 - RNA, 23 nt, artificial
  Completely synthesized
aagacaagaacaacuccaaaagg

SEQ ID NO: 3719 - RNA, 23 nt, artificial
  Completely synthesized
aaagacaagaacaacuccaaaag

SEQ ID NO: 3720 - RNA, 23 nt, artificial
  Completely synthesized
gaaagacaagaacaacuccaaaa

SEQ ID NO: 3721 - RNA, 23 nt, artificial
  Completely synthesized
ggaaagacaagaacaacuccaaa

SEQ ID NO: 3722 - RNA, 23 nt, artificial
  Completely synthesized
accuuauucuccuagugaauacu

SEQ ID NO: 3723 - RNA, 23 nt, artificial
  Completely synthesized
aaccuuauucuccuagugaauac

SEQ ID NO: 3724 - RNA, 23 nt, artificial
  Completely synthesized
aaaccuuauucuccuagugaaua

SEQ ID NO: 3725 - RNA, 23 nt, artificial
  Completely synthesized
aaaaccuuauucuccuagugaau

SEQ ID NO: 3726 - RNA, 23 nt, artificial
  Completely synthesized
gaaaaccuuauucuccuagugaa

SEQ ID NO: 3727 - RNA, 23 nt, artificial
  Completely synthesized
auguccaaagagcaguucaauga

SEQ ID NO: 3728 - RNA, 23 nt, artificial
  Completely synthesized
gauguccaaagagcaguucaaug

SEQ ID NO: 3729 - RNA, 23 nt, artificial
  Completely synthesized
ugauguccaaagagcaguucaau

SEQ ID NO: 3730 - RNA, 23 nt, artificial
  Completely synthesized
augauguccaaagagcaguucaa

SEQ ID NO: 3731 - RNA, 23 nt, artificial
  Completely synthesized
ugagaacacaccagagaaagaau

SEQ ID NO: 3732 - RNA, 23 nt, artificial
  Completely synthesized
gugagaacacaccagagaaagaa

SEQ ID NO: 3733 - RNA, 23 nt, artificial
  Completely synthesized
ugugagaacacaccagagaaaga

SEQ ID NO: 3734 - RNA, 23 nt, artificial
  Completely synthesized
augugagaacacaccagagaaag

SEQ ID NO: 3735 - RNA, 23 nt, artificial
  Completely synthesized
aaugugagaacacaccagagaaa

SEQ ID NO: 3736 - RNA, 23 nt, artificial
  Completely synthesized
gggaggagcuauuauccauuccu

SEQ ID NO: 3737 - RNA, 23 nt, artificial
  Completely synthesized
ugggaggagcuauuauccauucc

SEQ ID NO: 3738 - RNA, 23 nt, artificial
  Completely synthesized
uugggaggagcuauuauccauuc

SEQ ID NO: 3739 - RNA, 23 nt, artificial
  Completely synthesized
uuugggaggagcuauuauccauu

SEQ ID NO: 3740 - RNA, 23 nt, artificial
  Completely synthesized
guuugggaggagcuauuauccau

SEQ ID NO: 3741 - RNA, 23 nt, artificial
  Completely synthesized
ggauuugauugacauacuuugga

SEQ ID NO: 3742 - RNA, 23 nt, artificial
  Completely synthesized
uggauuugauugacauacuuugg

SEQ ID NO: 3743 - RNA, 23 nt, artificial
  Completely synthesized
auggauuugauugacauacuuug

SEQ ID NO: 3744 - RNA, 23 nt, artificial
  Completely synthesized
ccacauucccaaaucagaugcuu

SEQ ID NO: 3745 - RNA, 23 nt, artificial
  Completely synthesized
gcaggacauggauuugauugaca

SEQ ID NO: 3746 - RNA, 23 nt, artificial
  Completely synthesized
agcaggacauggauuugauugac

SEQ ID NO: 3747 - RNA, 23 nt, artificial
  Completely synthesized
cagcaggacauggauuugauuga

SEQ ID NO: 3748 - RNA, 23 nt, artificial
  Completely synthesized
ccagcaggacauggauuugauug

SEQ ID NO: 3749 - RNA, 23 nt, artificial
  Completely synthesized
cccagcaggacauggauuugauu

SEQ ID NO: 3750 - RNA, 23 nt, artificial
  Completely synthesized
cagcacauccagucagaaaccag

SEQ ID NO: 3751 - RNA, 23 nt, artificial
  Completely synthesized
ccagcacauccagucagaaacca

SEQ ID NO: 3752 - RNA, 23 nt, artificial
  Completely synthesized
cccagcacauccagucagaaacc

SEQ ID NO: 3753 - RNA, 23 nt, artificial
  Completely synthesized
gcccagcacauccagucagaaac

SEQ ID NO: 3754 - RNA, 23 nt, artificial
  Completely synthesized
agcccagcacauccagucagaaa

SEQ ID NO: 3755 - RNA, 23 nt, artificial
  Completely synthesized
guuucuguguaaguguaaauacu

SEQ ID NO: 3756 - RNA, 23 nt, artificial
  Completely synthesized
aguuucuguguaaguguaaauac

SEQ ID NO: 3757 - RNA, 23 nt, artificial
  Completely synthesized
uaguuucuguguaaguguaaaua

SEQ ID NO: 3758 - RNA, 23 nt, artificial
  Completely synthesized
cuaguuucuguguaaguguaaau

SEQ ID NO: 3759 - RNA, 23 nt, artificial
  Completely synthesized
gcuaguuucuguguaaguguaaa

SEQ ID NO: 3760 - RNA, 23 nt, artificial
  Completely synthesized
gaauacucccugcagcaaacaag

SEQ ID NO: 3761 - RNA, 23 nt, artificial
  Completely synthesized
ugaauacucccugcagcaaacaa

SEQ ID NO: 3762 - RNA, 23 nt, artificial
  Completely synthesized
gugaauacucccugcagcaaaca

SEQ ID NO: 3763 - RNA, 23 nt, artificial
  Completely synthesized
agugaauacucccugcagcaaac

SEQ ID NO: 3764 - RNA, 23 nt, artificial
  Completely synthesized
uagugaauacucccugcagcaaa

SEQ ID NO: 3765 - RNA, 23 nt, artificial
  Completely synthesized
ggaguaagucgagaaguauuuga

SEQ ID NO: 3766 - RNA, 23 nt, artificial
  Completely synthesized
caaugaagcucaacuugcauuaa

SEQ ID NO: 3767 - RNA, 23 nt, artificial
  Completely synthesized
ucaaugaagcucaacuugcauua

SEQ ID NO: 3768 - RNA, 23 nt, artificial
  Completely synthesized
uucaaugaagcucaacuugcauu

SEQ ID NO: 3769 - RNA, 23 nt, artificial
  Completely synthesized
guucaaugaagcucaacuugcau

SEQ ID NO: 3770 - RNA, 23 nt, artificial
  Completely synthesized
aguucaaugaagcucaacuugca

SEQ ID NO: 3771 - RNA, 23 nt, artificial
  Completely synthesized
aagaguaugagcuggaaaaacag

SEQ ID NO: 3772 - RNA, 23 nt, artificial
  Completely synthesized
aaagaguaugagcuggaaaaaca

SEQ ID NO: 3773 - RNA, 23 nt, artificial
  Completely synthesized
cccauucacaaaagacaaacauu

SEQ ID NO: 3774 - RNA, 23 nt, artificial
  Completely synthesized
ccccauucacaaaagacaaacau

SEQ ID NO: 3775 - RNA, 23 nt, artificial
  Completely synthesized
accccauucacaaaagacaaaca

SEQ ID NO: 3776 - RNA, 23 nt, artificial
  Completely synthesized
aaccccauucacaaaagacaaac

SEQ ID NO: 3777 - RNA, 23 nt, artificial
  Completely synthesized
aaaccccauucacaaaagacaaa

SEQ ID NO: 3778 - RNA, 23 nt, artificial
  Completely synthesized
ggcauuucacuaaacacaagucc

SEQ ID NO: 3779 - RNA, 23 nt, artificial
  Completely synthesized
cggcauuucacuaaacacaaguc

SEQ ID NO: 3780 - RNA, 23 nt, artificial
  Completely synthesized
ccggcauuucacuaaacacaagu

SEQ ID NO: 3781 - RNA, 23 nt, artificial
  Completely synthesized
uccggcauuucacuaaacacaag

SEQ ID NO: 3782 - RNA, 23 nt, artificial
  Completely synthesized
cuccggcauuucacuaaacacaa

SEQ ID NO: 3783 - RNA, 23 nt, artificial
  Completely synthesized
gcaugcccucaccugcuacuuua

SEQ ID NO: 3784 - RNA, 23 nt, artificial
  Completely synthesized
ccaaccaguugacagugaacuca

SEQ ID NO: 3785 - RNA, 23 nt, artificial
  Completely synthesized
cccaaccaguugacagugaacuc

SEQ ID NO: 3786 - RNA, 23 nt, artificial
  Completely synthesized
ccccaaccaguugacagugaacu

SEQ ID NO: 3787 - RNA, 23 nt, artificial
  Completely synthesized
accccaaccaguugacagugaac

SEQ ID NO: 3788 - RNA, 23 nt, artificial
  Completely synthesized
gaccccaaccaguugacagugaa

SEQ ID NO: 3789 - RNA, 23 nt, artificial
  Completely synthesized
gcaaguuugggaggagcuauuau

SEQ ID NO: 3790 - RNA, 23 nt, artificial
  Completely synthesized
agcaaguuugggaggagcuauua

SEQ ID NO: 3791 - RNA, 23 nt, artificial
  Completely synthesized
gagcaaguuugggaggagcuauu

SEQ ID NO: 3792 - RNA, 23 nt, artificial
  Completely synthesized
ugagcaaguuugggaggagcuau

SEQ ID NO: 3793 - RNA, 23 nt, artificial
  Completely synthesized
uugagcaaguuugggaggagcua

SEQ ID NO: 3794 - RNA, 23 nt, artificial
  Completely synthesized
acaacuagaugaagagacaggug

SEQ ID NO: 3795 - RNA, 23 nt, artificial
  Completely synthesized
uacaacuagaugaagagacaggu

SEQ ID NO: 3796 - RNA, 23 nt, artificial
  Completely synthesized
uuacaacuagaugaagagacagg

SEQ ID NO: 3797 - RNA, 23 nt, artificial
  Completely synthesized
guuacaacuagaugaagagacag

SEQ ID NO: 3798 - RNA, 23 nt, artificial
  Completely synthesized
aguuacaacuagaugaagagaca

SEQ ID NO: 3799 - RNA, 23 nt, artificial
  Completely synthesized
uaugcaaaaucauagccaaaacu

SEQ ID NO: 3800 - RNA, 23 nt, artificial
  Completely synthesized
cuaugcaaaaucauagccaaaac

SEQ ID NO: 3801 - RNA, 23 nt, artificial
  Completely synthesized
ucuaugcaaaaucauagccaaaa

SEQ ID NO: 3802 - RNA, 23 nt, artificial
  Completely synthesized
uucuaugcaaaaucauagccaaa

SEQ ID NO: 3803 - RNA, 23 nt, artificial
  Completely synthesized
auucuaugcaaaaucauagccaa

SEQ ID NO: 3804 - RNA, 23 nt, artificial
  Completely synthesized
agaaaaugacaaaagccuucacc

SEQ ID NO: 3805 - RNA, 23 nt, artificial
  Completely synthesized
gagaaaaugacaaaagccuucac

SEQ ID NO: 3806 - RNA, 23 nt, artificial
  Completely synthesized
ggagaaaaugacaaaagccuuca

SEQ ID NO: 3807 - RNA, 23 nt, artificial
  Completely synthesized
aggagaaaaugacaaaagccuuc

SEQ ID NO: 3808 - RNA, 23 nt, artificial
  Completely synthesized
aaggagaaaaugacaaaagccuu

SEQ ID NO: 3809 - RNA, 23 nt, artificial
  Completely synthesized
guaugagcuggaaaaacagaaaa

SEQ ID NO: 3810 - RNA, 23 nt, artificial
  Completely synthesized
aguaugagcuggaaaaacagaaa

SEQ ID NO: 3811 - RNA, 23 nt, artificial
  Completely synthesized
gaggauuccuucagcagcauccu

SEQ ID NO: 3812 - RNA, 23 nt, artificial
  Completely synthesized
ugaggauuccuucagcagcaucc

SEQ ID NO: 3813 - RNA, 23 nt, artificial
  Completely synthesized
uugaggauuccuucagcagcauc

SEQ ID NO: 3814 - RNA, 23 nt, artificial
  Completely synthesized
uuugaggauuccuucagcagcau

SEQ ID NO: 3815 - RNA, 23 nt, artificial
  Completely synthesized
uuuugaggauuccuucagcagca

SEQ ID NO: 3816 - RNA, 23 nt, artificial
  Completely synthesized
agauauagaucuuggaguaaguc

SEQ ID NO: 3817 - RNA, 23 nt, artificial
  Completely synthesized
aagauauagaucuuggaguaagu

SEQ ID NO: 3818 - RNA, 23 nt, artificial
  Completely synthesized
caagauauagaucuuggaguaag

SEQ ID NO: 3819 - RNA, 23 nt, artificial
  Completely synthesized
gcaagauauagaucuuggaguaa

SEQ ID NO: 3820 - RNA, 23 nt, artificial
  Completely synthesized
ggcaagauauagaucuuggagua

SEQ ID NO: 3821 - RNA, 23 nt, artificial
  Completely synthesized
ccuuuuucgcucaguuacaacua

SEQ ID NO: 3822 - RNA, 23 nt, artificial
  Completely synthesized
gccuuuuucgcucaguuacaacu

SEQ ID NO: 3823 - RNA, 23 nt, artificial
  Completely synthesized
agccuuuuucgcucaguuacaac

SEQ ID NO: 3824 - RNA, 23 nt, artificial
  Completely synthesized
aagccuuuuucgcucaguuacaa

SEQ ID NO: 3825 - RNA, 23 nt, artificial
  Completely synthesized
aaagccuuuuucgcucaguuaca

SEQ ID NO: 3826 - RNA, 23 nt, artificial
  Completely synthesized
gauaugacaucuggcuaaaaaga

SEQ ID NO: 3827 - RNA, 23 nt, artificial
  Completely synthesized
ugauaugacaucuggcuaaaaag

SEQ ID NO: 3828 - RNA, 23 nt, artificial
  Completely synthesized
augauaugacaucuggcuaaaaa

SEQ ID NO: 3829 - RNA, 23 nt, artificial
  Completely synthesized
gaugauaugacaucuggcuaaaa

SEQ ID NO: 3830 - RNA, 23 nt, artificial
  Completely synthesized
ugaugauaugacaucuggcuaaa

SEQ ID NO: 3831 - RNA, 23 nt, artificial
  Completely synthesized
ggagcaagagaaagccuuuuucg

SEQ ID NO: 3832 - RNA, 23 nt, artificial
  Completely synthesized
aggagcaagagaaagccuuuuuc

SEQ ID NO: 3833 - RNA, 23 nt, artificial
  Completely synthesized
aaggagcaagagaaagccuuuuu

SEQ ID NO: 3834 - RNA, 23 nt, artificial
  Completely synthesized
aaaggagcaagagaaagccuuuu

SEQ ID NO: 3835 - RNA, 23 nt, artificial
  Completely synthesized
aaaaggagcaagagaaagccuuu

SEQ ID NO: 3836 - RNA, 23 nt, artificial
  Completely synthesized
ucaguauguugaaucaguaguuu

SEQ ID NO: 3837 - RNA, 23 nt, artificial
  Completely synthesized
gucaguauguugaaucaguaguu

SEQ ID NO: 3838 - RNA, 23 nt, artificial
  Completely synthesized
ugucaguauguugaaucaguagu

SEQ ID NO: 3839 - RNA, 23 nt, artificial
  Completely synthesized
gugucaguauguugaaucaguag

SEQ ID NO: 3840 - RNA, 23 nt, artificial
  Completely synthesized
agugucaguauguugaaucagua

SEQ ID NO: 3841 - RNA, 23 nt, artificial
  Completely synthesized
agaguaugagcuggaaaaacaga

SEQ ID NO: 3842 - RNA, 23 nt, artificial
  Completely synthesized
gggcaaaagcucuccauauccca

SEQ ID NO: 3843 - RNA, 23 nt, artificial
  Completely synthesized
agggcaaaagcucuccauauccc

SEQ ID NO: 3844 - RNA, 23 nt, artificial
  Completely synthesized
uagggcaaaagcucuccauaucc

SEQ ID NO: 3845 - RNA, 23 nt, artificial
  Completely synthesized
uuagggcaaaagcucuccauauc

SEQ ID NO: 3846 - RNA, 23 nt, artificial
  Completely synthesized
cuuagggcaaaagcucuccauau

SEQ ID NO: 3847 - RNA, 23 nt, artificial
  Completely synthesized
aaaccacccugaaagcacagcag

SEQ ID NO: 3848 - RNA, 23 nt, artificial
  Completely synthesized
aaaaccacccugaaagcacagca

SEQ ID NO: 3849 - RNA, 23 nt, artificial
  Completely synthesized
caaaaccacccugaaagcacagc

SEQ ID NO: 3850 - RNA, 23 nt, artificial
  Completely synthesized
ccaaaaccacccugaaagcacag

SEQ ID NO: 3851 - RNA, 23 nt, artificial
  Completely synthesized
accaaaaccacccugaaagcaca

SEQ ID NO: 3852 - RNA, 23 nt, artificial
  Completely synthesized
acuuugcaaagcuuucaaccaaa

SEQ ID NO: 3853 - RNA, 23 nt, artificial
  Completely synthesized
gacagugaacucauuaaauucag

SEQ ID NO: 3854 - RNA, 23 nt, artificial
  Completely synthesized
ugacagugaacucauuaaauuca

SEQ ID NO: 3855 - RNA, 23 nt, artificial
  Completely synthesized
uugacagugaacucauuaaauuc

SEQ ID NO: 3856 - RNA, 23 nt, artificial
  Completely synthesized
guugacagugaacucauuaaauu

SEQ ID NO: 3857 - RNA, 23 nt, artificial
  Completely synthesized
aguugacagugaacucauuaaau

SEQ ID NO: 3858 - RNA, 23 nt, artificial
  Completely synthesized
caguugacagugaacucauuaaa

SEQ ID NO: 3859 - RNA, 23 nt, artificial
  Completely synthesized
ccaguugacagugaacucauuaa

SEQ ID NO: 3860 - RNA, 23 nt, artificial
  Completely synthesized
accaguugacagugaacucauua

SEQ ID NO: 3861 - RNA, 23 nt, artificial
  Completely synthesized
aaccaguugacagugaacucauu

SEQ ID NO: 3862 - RNA, 23 nt, artificial
  Completely synthesized
ucccguuuguagaugacaaugag

SEQ ID NO: 3863 - RNA, 23 nt, artificial
  Completely synthesized
uucccguuuguagaugacaauga

SEQ ID NO: 3864 - RNA, 23 nt, artificial
  Completely synthesized
auucccguuuguagaugacaaug

SEQ ID NO: 3865 - RNA, 23 nt, artificial
  Completely synthesized
cauucccguuuguagaugacaau

SEQ ID NO: 3866 - RNA, 23 nt, artificial
  Completely synthesized
acauucccguuuguagaugacaa

SEQ ID NO: 3867 - RNA, 23 nt, artificial
  Completely synthesized
agacauucccguuuguagaugac

SEQ ID NO: 3868 - RNA, 23 nt, artificial
  Completely synthesized
cagacauucccguuuguagauga

SEQ ID NO: 3869 - RNA, 23 nt, artificial
  Completely synthesized
gcagacauucccguuuguagaug

SEQ ID NO: 3870 - RNA, 23 nt, artificial
  Completely synthesized
cgcagacauucccguuuguagau

SEQ ID NO: 3871 - RNA, 23 nt, artificial
  Completely synthesized
gcgcagacauucccguuuguaga

SEQ ID NO: 3872 - RNA, 23 nt, artificial
  Completely synthesized
cugugaugugaaaugcucauacu

SEQ ID NO: 3873 - RNA, 23 nt, artificial
  Completely synthesized
acugugaugugaaaugcucauac

SEQ ID NO: 3874 - RNA, 23 nt, artificial
  Completely synthesized
uacugugaugugaaaugcucaua

SEQ ID NO: 3875 - RNA, 23 nt, artificial
  Completely synthesized
cuacugugaugugaaaugcucau

SEQ ID NO: 3876 - RNA, 23 nt, artificial
  Completely synthesized
ccuacugugaugugaaaugcuca

SEQ ID NO: 3877 - RNA, 23 nt, artificial
  Completely synthesized
cuugaaaaggaaagacaagaaca

SEQ ID NO: 3878 - RNA, 23 nt, artificial
  Completely synthesized
acaagagaugaacuuagggcaaa

SEQ ID NO: 3879 - RNA, 23 nt, artificial
  Completely synthesized
ggaggcucaucucacaagagaug

SEQ ID NO: 3880 - RNA, 23 nt, artificial
  Completely synthesized
uggaggcucaucucacaagagau

SEQ ID NO: 3881 - RNA, 23 nt, artificial
  Completely synthesized
uuggaggcucaucucacaagaga

SEQ ID NO: 3882 - RNA, 23 nt, artificial
  Completely synthesized
cuuggaggcucaucucacaagag

SEQ ID NO: 3883 - RNA, 23 nt, artificial
  Completely synthesized
gcuuggaggcucaucucacaaga

SEQ ID NO: 3884 - RNA, 23 nt, artificial
  Completely synthesized
aaguccuggucaucggaaaaccc

SEQ ID NO: 3885 - RNA, 23 nt, artificial
  Completely synthesized
uaaguccuggucaucggaaaacc

SEQ ID NO: 3886 - RNA, 23 nt, artificial
  Completely synthesized
guaaguccuggucaucggaaaac

SEQ ID NO: 3887 - RNA, 23 nt, artificial
  Completely synthesized
uguaaguccuggucaucggaaaa

SEQ ID NO: 3888 - RNA, 23 nt, artificial
  Completely synthesized
cuguaaguccuggucaucggaaa

SEQ ID NO: 3889 - RNA, 23 nt, artificial
  Completely synthesized
accagaacacucaguggaaucuu

SEQ ID NO: 3890 - RNA, 23 nt, artificial
  Completely synthesized
caccagaacacucaguggaaucu

SEQ ID NO: 3891 - RNA, 23 nt, artificial
  Completely synthesized
ucaccagaacacucaguggaauc

SEQ ID NO: 3892 - RNA, 23 nt, artificial
  Completely synthesized
aucaccagaacacucaguggaau

SEQ ID NO: 3893 - RNA, 23 nt, artificial
  Completely synthesized
caucaccagaacacucaguggaa

SEQ ID NO: 3894 - RNA, 23 nt, artificial
  Completely synthesized
ugaucuaucacuuugcaaagcuu

SEQ ID NO: 3895 - RNA, 23 nt, artificial
  Completely synthesized
cugaucuaucacuuugcaaagcu

SEQ ID NO: 3896 - RNA, 23 nt, artificial
  Completely synthesized
ucugaucuaucacuuugcaaagc

SEQ ID NO: 3897 - RNA, 23 nt, artificial
  Completely synthesized
uucugaucuaucacuuugcaaag

SEQ ID NO: 3898 - RNA, 23 nt, artificial
  Completely synthesized
uuucugaucuaucacuuugcaaa

SEQ ID NO: 3899 - RNA, 23 nt, artificial
  Completely synthesized
ccaguaucagcaacagcaugccc

SEQ ID NO: 3900 - RNA, 23 nt, artificial
  Completely synthesized
cccaguaucagcaacagcaugcc

SEQ ID NO: 3901 - RNA, 23 nt, artificial
  Completely synthesized
gcccaguaucagcaacagcaugc

SEQ ID NO: 3902 - RNA, 23 nt, artificial
  Completely synthesized
agcccaguaucagcaacagcaug

SEQ ID NO: 3903 - RNA, 23 nt, artificial
  Completely synthesized
gagcccaguaucagcaacagcau

SEQ ID NO: 3904 - RNA, 23 nt, artificial
  Completely synthesized
agucuucauugcuacuaaucagg

SEQ ID NO: 3905 - RNA, 23 nt, artificial
  Completely synthesized
agcugguacuaauaaaggauuau

SEQ ID NO: 3906 - RNA, 23 nt, artificial
  Completely synthesized
gagcugguacuaauaaaggauua

SEQ ID NO: 3907 - RNA, 23 nt, artificial
  Completely synthesized
agagcugguacuaauaaaggauu

SEQ ID NO: 3908 - RNA, 23 nt, artificial
  Completely synthesized
gagugucaguauguugaaucagu

SEQ ID NO: 3909 - RNA, 23 nt, artificial
  Completely synthesized
uaaaguggcugcucagaauugca

SEQ ID NO: 3910 - RNA, 23 nt, artificial
  Completely synthesized
auaaaguggcugcucagaauugc

SEQ ID NO: 3911 - RNA, 23 nt, artificial
  Completely synthesized
aauaaaguggcugcucagaauug

SEQ ID NO: 3912 - RNA, 23 nt, artificial
  Completely synthesized
gaauaaaguggcugcucagaauu

SEQ ID NO: 3913 - RNA, 23 nt, artificial
  Completely synthesized
agaauaaaguggcugcucagaau

SEQ ID NO: 3914 - RNA, 23 nt, artificial
  Completely synthesized
cccauucccuguagaaaaaauca

SEQ ID NO: 3915 - RNA, 23 nt, artificial
  Completely synthesized
ucccauucccuguagaaaaaauc

SEQ ID NO: 3916 - RNA, 23 nt, artificial
  Completely synthesized
aucccauucccuguagaaaaaau

SEQ ID NO: 3917 - RNA, 23 nt, artificial
  Completely synthesized
uaucccauucccuguagaaaaaa

SEQ ID NO: 3918 - RNA, 23 nt, artificial
  Completely synthesized
auaucccauucccuguagaaaaa

SEQ ID NO: 3919 - RNA, 23 nt, artificial
  Completely synthesized
agaacacaccagagaaagaauug

SEQ ID NO: 3920 - RNA, 23 nt, artificial
  Completely synthesized
gagaacacaccagagaaagaauu

SEQ ID NO: 3921 - RNA, 23 nt, artificial
  Completely synthesized
cgugcaugaugcccaaugugaga

SEQ ID NO: 3922 - RNA, 23 nt, artificial
  Completely synthesized
acgugcaugaugcccaaugugag

SEQ ID NO: 3923 - RNA, 23 nt, artificial
  Completely synthesized
cacgugcaugaugcccaauguga

SEQ ID NO: 3924 - RNA, 23 nt, artificial
  Completely synthesized
ccagaacacucaguggaaucuuc

SEQ ID NO: 3925 - RNA, 23 nt, artificial
  Completely synthesized
caguguggcaucaccagaacacu

SEQ ID NO: 3926 - RNA, 23 nt, artificial
  Completely synthesized
ccaguguggcaucaccagaacac

SEQ ID NO: 3927 - RNA, 23 nt, artificial
  Completely synthesized
cccaguguggcaucaccagaaca

SEQ ID NO: 3928 - RNA, 23 nt, artificial
  Completely synthesized
ucccaguguggcaucaccagaac

SEQ ID NO: 3929 - RNA, 23 nt, artificial
  Completely synthesized
gucccaguguggcaucaccagaa

SEQ ID NO: 3930 - RNA, 23 nt, artificial
  Completely synthesized
ccaaacugacagaaguugacaau

SEQ ID NO: 3931 - RNA, 23 nt, artificial
  Completely synthesized
gccaaacugacagaaguugacaa

SEQ ID NO: 3932 - RNA, 23 nt, artificial
  Completely synthesized
agccaaacugacagaaguugaca

SEQ ID NO: 3933 - RNA, 23 nt, artificial
  Completely synthesized
aagccaaacugacagaaguugac

SEQ ID NO: 3934 - RNA, 23 nt, artificial
  Completely synthesized
gaagccaaacugacagaaguuga

SEQ ID NO: 3935 - RNA, 23 nt, artificial
  Completely synthesized
gacgguaugcaacaggacauuga

SEQ ID NO: 3936 - RNA, 23 nt, artificial
  Completely synthesized
agacgguaugcaacaggacauug

SEQ ID NO: 3937 - RNA, 23 nt, artificial
  Completely synthesized
uagacgguaugcaacaggacauu

SEQ ID NO: 3938 - RNA, 23 nt, artificial
  Completely synthesized
uuagacgguaugcaacaggacau

SEQ ID NO: 3939 - RNA, 23 nt, artificial
  Completely synthesized
uuuagacgguaugcaacaggaca

SEQ ID NO: 3940 - RNA, 23 nt, artificial
  Completely synthesized
cagucagaaaccaguggaucugc

SEQ ID NO: 3941 - RNA, 23 nt, artificial
  Completely synthesized
ccagucagaaaccaguggaucug

SEQ ID NO: 3942 - RNA, 23 nt, artificial
  Completely synthesized
uccagucagaaaccaguggaucu

SEQ ID NO: 3943 - RNA, 23 nt, artificial
  Completely synthesized
auccagucagaaaccaguggauc

SEQ ID NO: 3944 - RNA, 23 nt, artificial
  Completely synthesized
cauccagucagaaaccaguggau

SEQ ID NO: 3945 - RNA, 23 nt, artificial
  Completely synthesized
ucccagcaggacauggauuugau

SEQ ID NO: 3946 - RNA, 23 nt, artificial
  Completely synthesized
acaggugaauuucucccaauuca

SEQ ID NO: 3947 - RNA, 23 nt, artificial
  Completely synthesized
gacaggugaauuucucccaauuc

SEQ ID NO: 3948 - RNA, 23 nt, artificial
  Completely synthesized
agacaggugaauuucucccaauu

SEQ ID NO: 3949 - RNA, 23 nt, artificial
  Completely synthesized
gagacaggugaauuucucccaau

SEQ ID NO: 3950 - RNA, 23 nt, artificial
  Completely synthesized
agagacaggugaauuucucccaa

SEQ ID NO: 3951 - RNA, 23 nt, artificial
  Completely synthesized
aaaggagaaaaugacaaaagccu

SEQ ID NO: 3952 - RNA, 23 nt, artificial
  Completely synthesized
aaaaggagaaaaugacaaaagcc

SEQ ID NO: 3953 - RNA, 23 nt, artificial
  Completely synthesized
aaaaaggagaaaaugacaaaagc

SEQ ID NO: 3954 - RNA, 23 nt, artificial
  Completely synthesized
gaaaaaggagaaaaugacaaaag

SEQ ID NO: 3955 - RNA, 23 nt, artificial
  Completely synthesized
agaaaaaggagaaaaugacaaaa

SEQ ID NO: 3956 - RNA, 23 nt, artificial
  Completely synthesized
aagaaaaaggagaaaaugacaaa

SEQ ID NO: 3957 - RNA, 23 nt, artificial
  Completely synthesized
aaagaaaaaggagaaaaugacaa

SEQ ID NO: 3958 - RNA, 23 nt, artificial
  Completely synthesized
caaagaaaaaggagaaaaugaca

SEQ ID NO: 3959 - RNA, 23 nt, artificial
  Completely synthesized
acgaaaugauguccaaagagcag

SEQ ID NO: 3960 - RNA, 23 nt, artificial
  Completely synthesized
aacgaaaugauguccaaagagca

SEQ ID NO: 3961 - RNA, 23 nt, artificial
  Completely synthesized
ucccuguuguugacuucaacgaa

SEQ ID NO: 3962 - RNA, 23 nt, artificial
  Completely synthesized
cacaagagaugaacuuagggcaa

SEQ ID NO: 3963 - RNA, 23 nt, artificial
  Completely synthesized
gaguaagucgagaaguauuugac

SEQ ID NO: 3964 - RNA, 23 nt, artificial
  Completely synthesized
auaugacaucuggcuaaaaagaa

SEQ ID NO: 3965 - RNA, 23 nt, artificial
  Completely synthesized
cgaaguuuucagcaugcuacgug

SEQ ID NO: 3966 - RNA, 23 nt, artificial
  Completely synthesized
ucgaaguuuucagcaugcuacgu

SEQ ID NO: 3967 - RNA, 23 nt, artificial
  Completely synthesized
cucgaaguuuucagcaugcuacg

SEQ ID NO: 3968 - RNA, 23 nt, artificial
  Completely synthesized
ucucgaaguuuucagcaugcuac

SEQ ID NO: 3969 - RNA, 23 nt, artificial
  Completely synthesized
aucucgaaguuuucagcaugcua

SEQ ID NO: 3970 - RNA, 23 nt, artificial
  Completely synthesized
ccuuauaucucgaaguuuucagc

SEQ ID NO: 3971 - RNA, 23 nt, artificial
  Completely synthesized
accuuauaucucgaaguuuucag

SEQ ID NO: 3972 - RNA, 23 nt, artificial
  Completely synthesized
caccuuauaucucgaaguuuuca

SEQ ID NO: 3973 - RNA, 23 nt, artificial
  Completely synthesized
gcaccuuauaucucgaaguuuuc

SEQ ID NO: 3974 - RNA, 23 nt, artificial
  Completely synthesized
agcaccuuauaucucgaaguuuu

SEQ ID NO: 3975 - RNA, 23 nt, artificial
  Completely synthesized
agagcaagauuuagaucauuuga

SEQ ID NO: 3976 - RNA, 23 nt, artificial
  Completely synthesized
uagagcaagauuuagaucauuug

SEQ ID NO: 3977 - RNA, 23 nt, artificial
  Completely synthesized
cuagagcaagauuuagaucauuu

SEQ ID NO: 3978 - RNA, 23 nt, artificial
  Completely synthesized
acuagagcaagauuuagaucauu

SEQ ID NO: 3979 - RNA, 23 nt, artificial
  Completely synthesized
aacuagagcaagauuuagaucau

SEQ ID NO: 3980 - RNA, 23 nt, artificial
  Completely synthesized
aaaugauguccaaagagcaguuc

SEQ ID NO: 3981 - RNA, 23 nt, artificial
  Completely synthesized
gaaaugauguccaaagagcaguu

SEQ ID NO: 3982 - RNA, 23 nt, artificial
  Completely synthesized
cgaaaugauguccaaagagcagu

SEQ ID NO: 3983 - RNA, 23 nt, artificial
  Completely synthesized
gaguaugagcuggaaaaacagaa

SEQ ID NO: 3984 - RNA, 23 nt, artificial
  Completely synthesized
cacaaaagacaaacauucaagcc

SEQ ID NO: 3985 - RNA, 23 nt, artificial
  Completely synthesized
ucacaaaagacaaacauucaagc

SEQ ID NO: 3986 - RNA, 23 nt, artificial
  Completely synthesized
uucacaaaagacaaacauucaag

SEQ ID NO: 3987 - RNA, 23 nt, artificial
  Completely synthesized
auucacaaaagacaaacauucaa

SEQ ID NO: 3988 - RNA, 23 nt, artificial
  Completely synthesized
cauucacaaaagacaaacauuca

SEQ ID NO: 3989 - RNA, 23 nt, artificial
  Completely synthesized
caaugugagaacacaccagagaa

SEQ ID NO: 3990 - RNA, 23 nt, artificial
  Completely synthesized
gaaugguccuaaaacaccaguac

SEQ ID NO: 3991 - RNA, 23 nt, artificial
  Completely synthesized
agaaugguccuaaaacaccagua

SEQ ID NO: 3992 - RNA, 23 nt, artificial
  Completely synthesized
cagaaugguccuaaaacaccagu

SEQ ID NO: 3993 - RNA, 23 nt, artificial
  Completely synthesized
aaugggcccauugauguuucuga

SEQ ID NO: 3994 - RNA, 23 nt, artificial
  Completely synthesized
uccaaguccagaagccaaacuga

SEQ ID NO: 3995 - RNA, 23 nt, artificial
  Completely synthesized
uuccaaguccagaagccaaacug

SEQ ID NO: 3996 - RNA, 23 nt, artificial
  Completely synthesized
guuccaaguccagaagccaaacu

SEQ ID NO: 3997 - RNA, 23 nt, artificial
  Completely synthesized
gguuccaaguccagaagccaaac

SEQ ID NO: 3998 - RNA, 23 nt, artificial
  Completely synthesized
ugguuccaaguccagaagccaaa

SEQ ID NO: 3999 - RNA, 23 nt, artificial
  Completely synthesized
uggcugcucagaauugcagaaaa

SEQ ID NO: 4000 - RNA, 23 nt, artificial
  Completely synthesized
cccuguagaaaaaaucauuaacc

SEQ ID NO: 4001 - RNA, 23 nt, artificial
  Completely synthesized
ucccuguagaaaaaaucauuaac

SEQ ID NO: 4002 - RNA, 23 nt, artificial
  Completely synthesized
uucccuguagaaaaaaucauuaa

SEQ ID NO: 4003 - RNA, 23 nt, artificial
  Completely synthesized
auucccuguagaaaaaaucauua

SEQ ID NO: 4004 - RNA, 23 nt, artificial
  Completely synthesized
cauucccuguagaaaaaaucauu

SEQ ID NO: 4005 - RNA, 23 nt, artificial
  Completely synthesized
aguccuggucaucggaaaacccc

SEQ ID NO: 4006 - RNA, 23 nt, artificial
  Completely synthesized
agaucuuggaguaagucgagaag

SEQ ID NO: 4007 - RNA, 23 nt, artificial
  Completely synthesized
uagaucuuggaguaagucgagaa

SEQ ID NO: 4008 - RNA, 23 nt, artificial
  Completely synthesized
auagaucuuggaguaagucgaga

SEQ ID NO: 4009 - RNA, 23 nt, artificial
  Completely synthesized
uauagaucuuggaguaagucgag

SEQ ID NO: 4010 - RNA, 23 nt, artificial
  Completely synthesized
auauagaucuuggaguaagucga

SEQ ID NO: 4011 - RNA, 23 nt, artificial
  Completely synthesized
caaccaguugacagugaacucau

SEQ ID NO: 4012 - RNA, 23 nt, artificial
  Completely synthesized
aaagaaguagguaacuguagucc

SEQ ID NO: 4013 - RNA, 23 nt, artificial
  Completely synthesized
aaaagaaguagguaacuguaguc

SEQ ID NO: 4014 - RNA, 23 nt, artificial
  Completely synthesized
aaaaagaaguagguaacuguagu

SEQ ID NO: 4015 - RNA, 23 nt, artificial
  Completely synthesized
gaaaaagaaguagguaacuguag

SEQ ID NO: 4016 - RNA, 23 nt, artificial
  Completely synthesized
ggaaaaagaaguagguaacugua

SEQ ID NO: 4017 - RNA, 23 nt, artificial
  Completely synthesized
aggcaagauauagaucuuggagu

SEQ ID NO: 4018 - RNA, 23 nt, artificial
  Completely synthesized
gaggcaagauauagaucuuggag

SEQ ID NO: 4019 - RNA, 23 nt, artificial
  Completely synthesized
ggaggcaagauauagaucuugga

SEQ ID NO: 4020 - RNA, 23 nt, artificial
  Completely synthesized
acuaccaugguuccaaguccaga

SEQ ID NO: 4021 - RNA, 23 nt, artificial
  Completely synthesized
gccuucaccuacugaaaaaacaa

SEQ ID NO: 4022 - RNA, 23 nt, artificial
  Completely synthesized
agccuucaccuacugaaaaaaca

SEQ ID NO: 4023 - RNA, 23 nt, artificial
  Completely synthesized
aagccuucaccuacugaaaaaac

SEQ ID NO: 4024 - RNA, 23 nt, artificial
  Completely synthesized
aaagccuucaccuacugaaaaaa

SEQ ID NO: 4025 - RNA, 23 nt, artificial
  Completely synthesized
aaaagccuucaccuacugaaaaa

SEQ ID NO: 4026 - RNA, 23 nt, artificial
  Completely synthesized
cgcuuggaggcucaucucacaag

SEQ ID NO: 4027 - RNA, 23 nt, artificial
  Completely synthesized
ccgcuuggaggcucaucucacaa

SEQ ID NO: 4028 - RNA, 23 nt, artificial
  Completely synthesized
gccgcuuggaggcucaucucaca

SEQ ID NO: 4029 - RNA, 23 nt, artificial
  Completely synthesized
cgacggaaagaguaugagcugga

SEQ ID NO: 4030 - RNA, 23 nt, artificial
  Completely synthesized
gccuguaaguccuggucaucgga

SEQ ID NO: 4031 - RNA, 23 nt, artificial
  Completely synthesized
ugccuguaaguccuggucaucgg

SEQ ID NO: 4032 - RNA, 23 nt, artificial
  Completely synthesized
uugccuguaaguccuggucaucg

SEQ ID NO: 4033 - RNA, 23 nt, artificial
  Completely synthesized
auugccuguaaguccuggucauc

SEQ ID NO: 4034 - RNA, 23 nt, artificial
  Completely synthesized
aauugccuguaaguccuggucau

SEQ ID NO: 4035 - RNA, 23 nt, artificial
  Completely synthesized
agcuauuauccauuccugaguua

SEQ ID NO: 4036 - RNA, 23 nt, artificial
  Completely synthesized
gagcuauuauccauuccugaguu

SEQ ID NO: 4037 - RNA, 23 nt, artificial
  Completely synthesized
ggagcuauuauccauuccugagu

SEQ ID NO: 4038 - RNA, 23 nt, artificial
  Completely synthesized
aggagcuauuauccauuccugag

SEQ ID NO: 4039 - RNA, 23 nt, artificial
  Completely synthesized
gaggagcuauuauccauuccuga

SEQ ID NO: 4040 - RNA, 23 nt, artificial
  Completely synthesized
acuuuggaggcaagauauagauc

SEQ ID NO: 4041 - RNA, 23 nt, artificial
  Completely synthesized
uacuuuggaggcaagauauagau

SEQ ID NO: 4042 - RNA, 23 nt, artificial
  Completely synthesized
auacuuuggaggcaagauauaga

SEQ ID NO: 4043 - RNA, 23 nt, artificial
  Completely synthesized
cauacuuuggaggcaagauauag

SEQ ID NO: 4044 - RNA, 23 nt, artificial
  Completely synthesized
acauacuuuggaggcaagauaua

SEQ ID NO: 4045 - RNA, 23 nt, artificial
  Completely synthesized
caggacauggauuugauugacau

SEQ ID NO: 4046 - RNA, 23 nt, artificial
  Completely synthesized
cgcucaguuacaacuagaugaag

SEQ ID NO: 4047 - RNA, 23 nt, artificial
  Completely synthesized
ucgcucaguuacaacuagaugaa

SEQ ID NO: 4048 - RNA, 23 nt, artificial
  Completely synthesized
uucgcucaguuacaacuagauga

SEQ ID NO: 4049 - RNA, 23 nt, artificial
  Completely synthesized
uuucgcucaguuacaacuagaug

SEQ ID NO: 4050 - RNA, 23 nt, artificial
  Completely synthesized
uuuucgcucaguuacaacuagau

SEQ ID NO: 4051 - RNA, 23 nt, artificial
  Completely synthesized
aagaauaaaguggcugcucagaa

SEQ ID NO: 4052 - RNA, 23 nt, artificial
  Completely synthesized
uaagaauaaaguggcugcucaga

SEQ ID NO: 4053 - RNA, 23 nt, artificial
  Completely synthesized
guaagaauaaaguggcugcucag

SEQ ID NO: 4054 - RNA, 23 nt, artificial
  Completely synthesized
gguaagaauaaaguggcugcuca

SEQ ID NO: 4055 - RNA, 23 nt, artificial
  Completely synthesized
gaaagaauugccuguaaguccug

SEQ ID NO: 4056 - RNA, 23 nt, artificial
  Completely synthesized
agaaagaauugccuguaaguccu

SEQ ID NO: 4057 - RNA, 23 nt, artificial
  Completely synthesized
gaacacaccagagaaagaauugc

SEQ ID NO: 4058 - RNA, 23 nt, artificial
  Completely synthesized
ccugcuacuuuaagccauucacu

SEQ ID NO: 4059 - RNA, 23 nt, artificial
  Completely synthesized
accugcuacuuuaagccauucac

SEQ ID NO: 4060 - RNA, 23 nt, artificial
  Completely synthesized
caccugcuacuuuaagccauuca

SEQ ID NO: 4061 - RNA, 23 nt, artificial
  Completely synthesized
ucaccugcuacuuuaagccauuc

SEQ ID NO: 4062 - RNA, 23 nt, artificial
  Completely synthesized
cucaccugcuacuuuaagccauu

SEQ ID NO: 4063 - RNA, 23 nt, artificial
  Completely synthesized
cauaucccauucccuguagaaaa

SEQ ID NO: 4064 - RNA, 23 nt, artificial
  Completely synthesized
ccauucacaaaagacaaacauuc

SEQ ID NO: 4065 - RNA, 23 nt, artificial
  Completely synthesized
aaacugacagaaguugacaauua

SEQ ID NO: 4066 - RNA, 23 nt, artificial
  Completely synthesized
cagcccagcacauccagucagaa

SEQ ID NO: 4067 - RNA, 23 nt, artificial
  Completely synthesized
ggcuaguuucuguguaaguguaa

SEQ ID NO: 4068 - RNA, 23 nt, artificial
  Completely synthesized
ucaccuacugaaaaaacaacuca

SEQ ID NO: 4069 - RNA, 23 nt, artificial
  Completely synthesized
uucaccuacugaaaaaacaacuc

SEQ ID NO: 4070 - RNA, 23 nt, artificial
  Completely synthesized
cuucaccuacugaaaaaacaacu

SEQ ID NO: 4071 - RNA, 23 nt, artificial
  Completely synthesized
ccuucaccuacugaaaaaacaac

SEQ ID NO: 4072 - RNA, 23 nt, artificial
  Completely synthesized
ggcucaucucacaagagaugaac

SEQ ID NO: 4073 - RNA, 23 nt, artificial
  Completely synthesized
aggcucaucucacaagagaugaa

SEQ ID NO: 4074 - RNA, 23 nt, artificial
  Completely synthesized
gaggcucaucucacaagagauga

SEQ ID NO: 4075 - RNA, 23 nt, artificial
  Completely synthesized
gucagcgacggaaagaguaugag

SEQ ID NO: 4076 - RNA, 23 nt, artificial
  Completely synthesized
agucagcgacggaaagaguauga

SEQ ID NO: 4077 - RNA, 23 nt, artificial
  Completely synthesized
cagucagcgacggaaagaguaug

SEQ ID NO: 4078 - RNA, 23 nt, artificial
  Completely synthesized
ucagucagcgacggaaagaguau

SEQ ID NO: 4079 - RNA, 23 nt, artificial
  Completely synthesized
uucagucagcgacggaaagagua

SEQ ID NO: 4080 - RNA, 23 nt, artificial
  Completely synthesized
cugaaguggaagagcuagauagu

SEQ ID NO: 4081 - RNA, 23 nt, artificial
  Completely synthesized
ucugaaguggaagagcuagauag

SEQ ID NO: 4082 - RNA, 23 nt, artificial
  Completely synthesized
uucugaaguggaagagcuagaua

SEQ ID NO: 4083 - RNA, 23 nt, artificial
  Completely synthesized
auucugaaguggaagagcuagau

SEQ ID NO: 4084 - RNA, 23 nt, artificial
  Completely synthesized
gauucugaaguggaagagcuaga

SEQ ID NO: 4085 - RNA, 23 nt, artificial
  Completely synthesized
agaaguagguaacuguaguccac

SEQ ID NO: 4086 - RNA, 23 nt, artificial
  Completely synthesized
aagaaguagguaacuguagucca

SEQ ID NO: 4087 - RNA, 23 nt, artificial
  Completely synthesized
gagacuaccaugguuccaagucc

SEQ ID NO: 4088 - RNA, 23 nt, artificial
  Completely synthesized
ugagacuaccaugguuccaaguc

SEQ ID NO: 4089 - RNA, 23 nt, artificial
  Completely synthesized
uugagacuaccaugguuccaagu

SEQ ID NO: 4090 - RNA, 23 nt, artificial
  Completely synthesized
guugagacuaccaugguuccaag

SEQ ID NO: 4091 - RNA, 23 nt, artificial
  Completely synthesized
gguugagacuaccaugguuccaa

SEQ ID NO: 4092 - RNA, 23 nt, artificial
  Completely synthesized
ggaggagcuauuauccauuccug

SEQ ID NO: 4093 - RNA, 23 nt, artificial
  Completely synthesized
ugacauacuuuggaggcaagaua

SEQ ID NO: 4094 - RNA, 23 nt, artificial
  Completely synthesized
uugacauacuuuggaggcaagau

SEQ ID NO: 4095 - RNA, 23 nt, artificial
  Completely synthesized
auugacauacuuuggaggcaaga

SEQ ID NO: 4096 - RNA, 23 nt, artificial
  Completely synthesized
gauugacauacuuuggaggcaag

SEQ ID NO: 4097 - RNA, 23 nt, artificial
  Completely synthesized
ugauugacauacuuuggaggcaa

SEQ ID NO: 4098 - RNA, 23 nt, artificial
  Completely synthesized
caggugaauuucucccaauucag

SEQ ID NO: 4099 - RNA, 23 nt, artificial
  Completely synthesized
aaauuauugcaaaacuaaccacu

SEQ ID NO: 4100 - RNA, 23 nt, artificial
  Completely synthesized
ggaaaaccuuauucuccuaguga

SEQ ID NO: 4101 - RNA, 23 nt, artificial
  Completely synthesized
uggaaaaccuuauucuccuagug

SEQ ID NO: 4102 - RNA, 23 nt, artificial
  Completely synthesized
auggaaaaccuuauucuccuagu

SEQ ID NO: 4103 - RNA, 23 nt, artificial
  Completely synthesized
gauggaaaaccuuauucuccuag

SEQ ID NO: 4104 - RNA, 23 nt, artificial
  Completely synthesized
agauggaaaaccuuauucuccua

SEQ ID NO: 4105 - RNA, 23 nt, artificial
  Completely synthesized
ugaagauggaaaaccuuauucuc

SEQ ID NO: 4106 - RNA, 23 nt, artificial
  Completely synthesized
augaagauggaaaaccuuauucu

SEQ ID NO: 4107 - RNA, 23 nt, artificial
  Completely synthesized
gaugaagauggaaaaccuuauuc

SEQ ID NO: 4108 - RNA, 23 nt, artificial
  Completely synthesized
ugaugaagauggaaaaccuuauu

SEQ ID NO: 4109 - RNA, 23 nt, artificial
  Completely synthesized
gugaugaagauggaaaaccuuau

SEQ ID NO: 4110 - RNA, 23 nt, artificial
  Completely synthesized
aaaacaacucagcaccuuauauc

SEQ ID NO: 4111 - RNA, 23 nt, artificial
  Completely synthesized
aaaaacaacucagcaccuuauau

SEQ ID NO: 4112 - RNA, 23 nt, artificial
  Completely synthesized
aaaaaacaacucagcaccuuaua

SEQ ID NO: 4113 - RNA, 23 nt, artificial
  Completely synthesized
gaaaaaacaacucagcaccuuau

SEQ ID NO: 4114 - RNA, 23 nt, artificial
  Completely synthesized
ugaaaaaacaacucagcaccuua

SEQ ID NO: 4115 - RNA, 23 nt, artificial
  Completely synthesized
auaguagaacuagagcaagauuu

SEQ ID NO: 4116 - RNA, 23 nt, artificial
  Completely synthesized
uauaguagaacuagagcaagauu

SEQ ID NO: 4117 - RNA, 23 nt, artificial
  Completely synthesized
auauaguagaacuagagcaagau

SEQ ID NO: 4118 - RNA, 23 nt, artificial
  Completely synthesized
aauauaguagaacuagagcaaga

SEQ ID NO: 4119 - RNA, 23 nt, artificial
  Completely synthesized
guggcugcucagaauugcagaaa

SEQ ID NO: 4120 - RNA, 23 nt, artificial
  Completely synthesized
aguggcugcucagaauugcagaa

SEQ ID NO: 4121 - RNA, 23 nt, artificial
  Completely synthesized
aaguggcugcucagaauugcaga

SEQ ID NO: 4122 - RNA, 23 nt, artificial
  Completely synthesized
cuucagucagcgacggaaagagu

SEQ ID NO: 4123 - RNA, 23 nt, artificial
  Completely synthesized
acuucagucagcgacggaaagag

SEQ ID NO: 4124 - RNA, 23 nt, artificial
  Completely synthesized
gacuucagucagcgacggaaaga

SEQ ID NO: 4125 - RNA, 23 nt, artificial
  Completely synthesized
ugacuucagucagcgacggaaag

SEQ ID NO: 4126 - RNA, 23 nt, artificial
  Completely synthesized
uugacuucagucagcgacggaaa

SEQ ID NO: 4127 - RNA, 23 nt, artificial
  Completely synthesized
uggccucagugauucugaagugg

SEQ ID NO: 4128 - RNA, 23 nt, artificial
  Completely synthesized
uuggccucagugauucugaagug

SEQ ID NO: 4129 - RNA, 23 nt, artificial
  Completely synthesized
cuuggccucagugauucugaagu

SEQ ID NO: 4130 - RNA, 23 nt, artificial
  Completely synthesized
acuuggccucagugauucugaag

SEQ ID NO: 4131 - RNA, 23 nt, artificial
  Completely synthesized
uacuuggccucagugauucugaa

SEQ ID NO: 4132 - RNA, 23 nt, artificial
  Completely synthesized
cagcuauggagacacacuacuug

SEQ ID NO: 4133 - RNA, 23 nt, artificial
  Completely synthesized
ccagcuauggagacacacuacuu

SEQ ID NO: 4134 - RNA, 23 nt, artificial
  Completely synthesized
uccagcuauggagacacacuacu

SEQ ID NO: 4135 - RNA, 23 nt, artificial
  Completely synthesized
uuccagcuauggagacacacuac

SEQ ID NO: 4136 - RNA, 23 nt, artificial
  Completely synthesized
cuuccagcuauggagacacacua

SEQ ID NO: 4137 - RNA, 23 nt, artificial
  Completely synthesized
gcuuucaaccaaaaccacccuga

SEQ ID NO: 4138 - RNA, 23 nt, artificial
  Completely synthesized
cagcauccucuccacagaagacc

SEQ ID NO: 4139 - RNA, 23 nt, artificial
  Completely synthesized
gcagcauccucuccacagaagac

SEQ ID NO: 4140 - RNA, 23 nt, artificial
  Completely synthesized
agcagcauccucuccacagaaga

SEQ ID NO: 4141 - RNA, 23 nt, artificial
  Completely synthesized
cagcagcauccucuccacagaag

SEQ ID NO: 4142 - RNA, 23 nt, artificial
  Completely synthesized
ucagcagcauccucuccacagaa

SEQ ID NO: 4143 - RNA, 23 nt, artificial
  Completely synthesized
uuccugaguuacagugucuuaau

SEQ ID NO: 4144 - RNA, 23 nt, artificial
  Completely synthesized
aguuugggaggagcuauuaucca

SEQ ID NO: 4145 - RNA, 23 nt, artificial
  Completely synthesized
aaguuugggaggagcuauuaucc

SEQ ID NO: 4146 - RNA, 23 nt, artificial
  Completely synthesized
caaguuugggaggagcuauuauc

SEQ ID NO: 4147 - RNA, 23 nt, artificial
  Completely synthesized
ccuguugauuuagacgguaugca

SEQ ID NO: 4148 - RNA, 23 nt, artificial
  Completely synthesized
cccuguugauuuagacgguaugc

SEQ ID NO: 4149 - RNA, 23 nt, artificial
  Completely synthesized
ccccuguugauuuagacgguaug

SEQ ID NO: 4150 - RNA, 23 nt, artificial
  Completely synthesized
gccccuguugauuuagacgguau

SEQ ID NO: 4151 - RNA, 23 nt, artificial
  Completely synthesized
agccccuguugauuuagacggua

SEQ ID NO: 4152 - RNA, 23 nt, artificial
  Completely synthesized
ucgagagcccagucuucauugcu

SEQ ID NO: 4153 - RNA, 23 nt, artificial
  Completely synthesized
aucgagagcccagucuucauugc

SEQ ID NO: 4154 - RNA, 23 nt, artificial
  Completely synthesized
caucgagagcccagucuucauug

SEQ ID NO: 4155 - RNA, 23 nt, artificial
  Completely synthesized
acaucgagagcccagucuucauu

SEQ ID NO: 4156 - RNA, 23 nt, artificial
  Completely synthesized
cacaucgagagcccagucuucau

SEQ ID NO: 4157 - RNA, 23 nt, artificial
  Completely synthesized
cggcuacguuucagucacuuguu

SEQ ID NO: 4158 - RNA, 23 nt, artificial
  Completely synthesized
ucggcuacguuucagucacuugu

SEQ ID NO: 4159 - RNA, 23 nt, artificial
  Completely synthesized
uucggcuacguuucagucacuug

SEQ ID NO: 4160 - RNA, 23 nt, artificial
  Completely synthesized
cuucggcuacguuucagucacuu

SEQ ID NO: 4161 - RNA, 23 nt, artificial
  Completely synthesized
ucuucggcuacguuucagucacu

SEQ ID NO: 4162 - RNA, 23 nt, artificial
  Completely synthesized
caaugagguuucuucggcuacgu

SEQ ID NO: 4163 - RNA, 23 nt, artificial
  Completely synthesized
acaaugagguuucuucggcuacg

SEQ ID NO: 4164 - RNA, 23 nt, artificial
  Completely synthesized
gacaaugagguuucuucggcuac

SEQ ID NO: 4165 - RNA, 23 nt, artificial
  Completely synthesized
ugacaaugagguuucuucggcua

SEQ ID NO: 4166 - RNA, 23 nt, artificial
  Completely synthesized
augacaaugagguuucuucggcu

SEQ ID NO: 4167 - RNA, 23 nt, artificial
  Completely synthesized
gacaagaacaacuccaaaaggag

SEQ ID NO: 4168 - RNA, 23 nt, artificial
  Completely synthesized
cuggaaaaacagaaaaaacuuga

SEQ ID NO: 4169 - RNA, 23 nt, artificial
  Completely synthesized
ucaucaugauggacuuggagcug

SEQ ID NO: 4170 - RNA, 23 nt, artificial
  Completely synthesized
cucaucaugauggacuuggagcu

SEQ ID NO: 4171 - RNA, 23 nt, artificial
  Completely synthesized
gcucaucaugauggacuuggagc

SEQ ID NO: 4172 - RNA, 23 nt, artificial
  Completely synthesized
agcucaucaugauggacuuggag

SEQ ID NO: 4173 - RNA, 23 nt, artificial
  Completely synthesized
cagcucaucaugauggacuugga

SEQ ID NO: 4174 - RNA, 23 nt, artificial
  Completely synthesized
ccauucccuguagaaaaaaucau

SEQ ID NO: 4175 - RNA, 23 nt, artificial
  Completely synthesized
gggauaugguacaacccuuguca

SEQ ID NO: 4176 - RNA, 23 nt, artificial
  Completely synthesized
ggggauaugguacaacccuuguc

SEQ ID NO: 4177 - RNA, 23 nt, artificial
  Completely synthesized
uggggauaugguacaacccuugu

SEQ ID NO: 4178 - RNA, 23 nt, artificial
  Completely synthesized
cuggggauaugguacaacccuug

SEQ ID NO: 4179 - RNA, 23 nt, artificial
  Completely synthesized
ucuggggauaugguacaacccuu

SEQ ID NO: 4180 - RNA, 23 nt, artificial
  Completely synthesized
aguggaagagcuagauagugccc

SEQ ID NO: 4181 - RNA, 23 nt, artificial
  Completely synthesized
aaguggaagagcuagauagugcc

SEQ ID NO: 4182 - RNA, 23 nt, artificial
  Completely synthesized
gaaguggaagagcuagauagugc

SEQ ID NO: 4183 - RNA, 23 nt, artificial
  Completely synthesized
ugaaguggaagagcuagauagug

SEQ ID NO: 4184 - RNA, 23 nt, artificial
  Completely synthesized
gcaucaccagaacacucagugga

SEQ ID NO: 4185 - RNA, 23 nt, artificial
  Completely synthesized
ggcaucaccagaacacucagugg

SEQ ID NO: 4186 - RNA, 23 nt, artificial
  Completely synthesized
uggcaucaccagaacacucagug

SEQ ID NO: 4187 - RNA, 23 nt, artificial
  Completely synthesized
guggcaucaccagaacacucagu

SEQ ID NO: 4188 - RNA, 23 nt, artificial
  Completely synthesized
uguggcaucaccagaacacucag

SEQ ID NO: 4189 - RNA, 23 nt, artificial
  Completely synthesized
uggaaaaagaaguagguaacugu

SEQ ID NO: 4190 - RNA, 23 nt, artificial
  Completely synthesized
auggaaaaagaaguagguaacug

SEQ ID NO: 4191 - RNA, 23 nt, artificial
  Completely synthesized
aauggaaaaagaaguagguaacu

SEQ ID NO: 4192 - RNA, 23 nt, artificial
  Completely synthesized
caauggaaaaagaaguagguaac

SEQ ID NO: 4193 - RNA, 23 nt, artificial
  Completely synthesized
ucaauggaaaaagaaguagguaa

SEQ ID NO: 4194 - RNA, 23 nt, artificial
  Completely synthesized
ugguugagacuaccaugguucca

SEQ ID NO: 4195 - RNA, 23 nt, artificial
  Completely synthesized
cugguugagacuaccaugguucc

SEQ ID NO: 4196 - RNA, 23 nt, artificial
  Completely synthesized
gcugguugagacuaccaugguuc

SEQ ID NO: 4197 - RNA, 23 nt, artificial
  Completely synthesized
agcugguugagacuaccaugguu

SEQ ID NO: 4198 - RNA, 23 nt, artificial
  Completely synthesized
gucacuuguuccugauauucccg

SEQ ID NO: 4199 - RNA, 23 nt, artificial
  Completely synthesized
agucacuuguuccugauauuccc

SEQ ID NO: 4200 - RNA, 23 nt, artificial
  Completely synthesized
cagucacuuguuccugauauucc

SEQ ID NO: 4201 - RNA, 23 nt, artificial
  Completely synthesized
ucagucacuuguuccugauauuc

SEQ ID NO: 4202 - RNA, 23 nt, artificial
  Completely synthesized
uucagucacuuguuccugauauu

SEQ ID NO: 4203 - RNA, 23 nt, artificial
  Completely synthesized
gacauucccguuuguagaugaca

SEQ ID NO: 4204 - RNA, 23 nt, artificial
  Completely synthesized
ggcgcagacauucccguuuguag

SEQ ID NO: 4205 - RNA, 23 nt, artificial
  Completely synthesized
uggcgcagacauucccguuugua

SEQ ID NO: 4206 - RNA, 23 nt, artificial
  Completely synthesized
uuggcgcagacauucccguuugu

SEQ ID NO: 4207 - RNA, 23 nt, artificial
  Completely synthesized
cagaugcuuuguacuuugaugac

SEQ ID NO: 4208 - RNA, 23 nt, artificial
  Completely synthesized
ucagaugcuuuguacuuugauga

SEQ ID NO: 4209 - RNA, 23 nt, artificial
  Completely synthesized
aucagaugcuuuguacuuugaug

SEQ ID NO: 4210 - RNA, 23 nt, artificial
  Completely synthesized
aaucagaugcuuuguacuuugau

SEQ ID NO: 4211 - RNA, 23 nt, artificial
  Completely synthesized
aaaucagaugcuuuguacuuuga

SEQ ID NO: 4212 - RNA, 23 nt, artificial
  Completely synthesized
gguugcccacauucccaaaucag

SEQ ID NO: 4213 - RNA, 23 nt, artificial
  Completely synthesized
agguugcccacauucccaaauca

SEQ ID NO: 4214 - RNA, 23 nt, artificial
  Completely synthesized
cagguugcccacauucccaaauc

SEQ ID NO: 4215 - RNA, 23 nt, artificial
  Completely synthesized
ccagguugcccacauucccaaau

SEQ ID NO: 4216 - RNA, 23 nt, artificial
  Completely synthesized
cccagguugcccacauucccaaa

SEQ ID NO: 4217 - RNA, 23 nt, artificial
  Completely synthesized
caguuacaacuagaugaagagac

SEQ ID NO: 4218 - RNA, 23 nt, artificial
  Completely synthesized
ucaguuacaacuagaugaagaga

SEQ ID NO: 4219 - RNA, 23 nt, artificial
  Completely synthesized
cucaguuacaacuagaugaagag

SEQ ID NO: 4220 - RNA, 23 nt, artificial
  Completely synthesized
gcucaguuacaacuagaugaaga

SEQ ID NO: 4221 - RNA, 23 nt, artificial
  Completely synthesized
auuuuaagagcugguacuaauaa

SEQ ID NO: 4222 - RNA, 23 nt, artificial
  Completely synthesized
aauuuuaagagcugguacuaaua

SEQ ID NO: 4223 - RNA, 23 nt, artificial
  Completely synthesized
gcaaaaucauagccaaaacuagu

SEQ ID NO: 4224 - RNA, 23 nt, artificial
  Completely synthesized
ugcaaaaucauagccaaaacuag

SEQ ID NO: 4225 - RNA, 23 nt, artificial
  Completely synthesized
augcaaaaucauagccaaaacua

SEQ ID NO: 4226 - RNA, 23 nt, artificial
  Completely synthesized
cuaaaagcuccuacugugaugug

SEQ ID NO: 4227 - RNA, 23 nt, artificial
  Completely synthesized
acuaaaagcuccuacugugaugu

SEQ ID NO: 4228 - RNA, 23 nt, artificial
  Completely synthesized
uacuaaaagcuccuacugugaug

SEQ ID NO: 4229 - RNA, 23 nt, artificial
  Completely synthesized
auacuaaaagcuccuacugugau

SEQ ID NO: 4230 - RNA, 23 nt, artificial
  Completely synthesized
uauacuaaaagcuccuacuguga

SEQ ID NO: 4231 - RNA, 23 nt, artificial
  Completely synthesized
aggaaagacaagaacaacuccaa

SEQ ID NO: 4232 - RNA, 23 nt, artificial
  Completely synthesized
aaauugcucaaagaaaaaggaga

SEQ ID NO: 4233 - RNA, 23 nt, artificial
  Completely synthesized
agcucaacuugcauuaauucggg

SEQ ID NO: 4234 - RNA, 23 nt, artificial
  Completely synthesized
aagcucaacuugcauuaauucgg

SEQ ID NO: 4235 - RNA, 23 nt, artificial
  Completely synthesized
gaagcucaacuugcauuaauucg

SEQ ID NO: 4236 - RNA, 23 nt, artificial
  Completely synthesized
ugaagcucaacuugcauuaauuc

SEQ ID NO: 4237 - RNA, 23 nt, artificial
  Completely synthesized
augaagcucaacuugcauuaauu

SEQ ID NO: 4238 - RNA, 23 nt, artificial
  Completely synthesized
aaugaagcucaacuugcauuaau

SEQ ID NO: 4239 - RNA, 23 nt, artificial
  Completely synthesized
caugaugcccaaugugagaacac

SEQ ID NO: 4240 - RNA, 23 nt, artificial
  Completely synthesized
gcaugaugcccaaugugagaaca

SEQ ID NO: 4241 - RNA, 23 nt, artificial
  Completely synthesized
ugcaugaugcccaaugugagaac

SEQ ID NO: 4242 - RNA, 23 nt, artificial
  Completely synthesized
gugcaugaugcccaaugugagaa

SEQ ID NO: 4243 - RNA, 23 nt, artificial
  Completely synthesized
gacuccggcauuucacuaaacac

SEQ ID NO: 4244 - RNA, 23 nt, artificial
  Completely synthesized
ugacuccggcauuucacuaaaca

SEQ ID NO: 4245 - RNA, 23 nt, artificial
  Completely synthesized
cugacuccggcauuucacuaaac

SEQ ID NO: 4246 - RNA, 23 nt, artificial
  Completely synthesized
ucugacuccggcauuucacuaaa

SEQ ID NO: 4247 - RNA, 23 nt, artificial
  Completely synthesized
uucugacuccggcauuucacuaa

SEQ ID NO: 4248 - RNA, 23 nt, artificial
  Completely synthesized
acagcagaauucaaugauucuga

SEQ ID NO: 4249 - RNA, 23 nt, artificial
  Completely synthesized
cacagcagaauucaaugauucug

SEQ ID NO: 4250 - RNA, 23 nt, artificial
  Completely synthesized
gcacagcagaauucaaugauucu

SEQ ID NO: 4251 - RNA, 23 nt, artificial
  Completely synthesized
agcacagcagaauucaaugauuc

SEQ ID NO: 4252 - RNA, 23 nt, artificial
  Completely synthesized
aagcacagcagaauucaaugauu

SEQ ID NO: 4253 - RNA, 23 nt, artificial
  Completely synthesized
gcauccucuccacagaagacccc

SEQ ID NO: 4254 - RNA, 23 nt, artificial
  Completely synthesized
agcauccucuccacagaagaccc

SEQ ID NO: 4255 - RNA, 23 nt, artificial
  Completely synthesized
agguaacuguaguccacauuuuc

SEQ ID NO: 4256 - RNA, 23 nt, artificial
  Completely synthesized
uagguaacuguaguccacauuuu

SEQ ID NO: 4257 - RNA, 23 nt, artificial
  Completely synthesized
guagguaacuguaguccacauuu

SEQ ID NO: 4258 - RNA, 23 nt, artificial
  Completely synthesized
aguagguaacuguaguccacauu

SEQ ID NO: 4259 - RNA, 23 nt, artificial
  Completely synthesized
aaguagguaacuguaguccacau

SEQ ID NO: 4260 - RNA, 23 nt, artificial
  Completely synthesized
auuuagacgguaugcaacaggac

SEQ ID NO: 4261 - RNA, 23 nt, artificial
  Completely synthesized
gauuuagacgguaugcaacagga

SEQ ID NO: 4262 - RNA, 23 nt, artificial
  Completely synthesized
cagcuuuuggcgcagacauuccc

SEQ ID NO: 4263 - RNA, 23 nt, artificial
  Completely synthesized
gcagcuuuuggcgcagacauucc

SEQ ID NO: 4264 - RNA, 23 nt, artificial
  Completely synthesized
ugcagcuuuuggcgcagacauuc

SEQ ID NO: 4265 - RNA, 23 nt, artificial
  Completely synthesized
augcagcuuuuggcgcagacauu

SEQ ID NO: 4266 - RNA, 23 nt, artificial
  Completely synthesized
caugcagcuuuuggcgcagacau

SEQ ID NO: 4267 - RNA, 23 nt, artificial
  Completely synthesized
guauggacaaaaaauggcauuuu

SEQ ID NO: 4268 - RNA, 23 nt, artificial
  Completely synthesized
uguauggacaaaaaauggcauuu

SEQ ID NO: 4269 - RNA, 23 nt, artificial
  Completely synthesized
cuguauggacaaaaaauggcauu

SEQ ID NO: 4270 - RNA, 23 nt, artificial
  Completely synthesized
acuguauggacaaaaaauggcau

SEQ ID NO: 4271 - RNA, 23 nt, artificial
  Completely synthesized
uacuguauggacaaaaaauggca

SEQ ID NO: 4272 - RNA, 23 nt, artificial
  Completely synthesized
cugagcuaguuuuuuuguacuau

SEQ ID NO: 4273 - RNA, 23 nt, artificial
  Completely synthesized
ucugagcuaguuuuuuuguacua

SEQ ID NO: 4274 - RNA, 23 nt, artificial
  Completely synthesized
uucugagcuaguuuuuuuguacu

SEQ ID NO: 4275 - RNA, 23 nt, artificial
  Completely synthesized
uuucugagcuaguuuuuuuguac

SEQ ID NO: 4276 - RNA, 23 nt, artificial
  Completely synthesized
uuuucugagcuaguuuuuuugua

SEQ ID NO: 4277 - RNA, 23 nt, artificial
  Completely synthesized
ggaggauuugaccuuuucugagc

SEQ ID NO: 4278 - RNA, 23 nt, artificial
  Completely synthesized
aggaggauuugaccuuuucugag

SEQ ID NO: 4279 - RNA, 23 nt, artificial
  Completely synthesized
uaggaggauuugaccuuuucuga

SEQ ID NO: 4280 - RNA, 23 nt, artificial
  Completely synthesized
uuaggaggauuugaccuuuucug

SEQ ID NO: 4281 - RNA, 23 nt, artificial
  Completely synthesized
uuuaggaggauuugaccuuuucu

SEQ ID NO: 4282 - RNA, 23 nt, artificial
  Completely synthesized
caaaagccuucaccuacugaaaa

SEQ ID NO: 4283 - RNA, 23 nt, artificial
  Completely synthesized
acaaaagccuucaccuacugaaa

SEQ ID NO: 4284 - RNA, 23 nt, artificial
  Completely synthesized
gaacuagagcaagauuuagauca

SEQ ID NO: 4285 - RNA, 23 nt, artificial
  Completely synthesized
aaauauaguagaacuagagcaag

SEQ ID NO: 4286 - RNA, 23 nt, artificial
  Completely synthesized
aaaauauaguagaacuagagcaa

SEQ ID NO: 4287 - RNA, 23 nt, artificial
  Completely synthesized
gguccacagcucaucaugaugga

SEQ ID NO: 4288 - RNA, 23 nt, artificial
  Completely synthesized
cgguccacagcucaucaugaugg

SEQ ID NO: 4289 - RNA, 23 nt, artificial
  Completely synthesized
acgguccacagcucaucaugaug

SEQ ID NO: 4290 - RNA, 23 nt, artificial
  Completely synthesized
cacgguccacagcucaucaugau

SEQ ID NO: 4291 - RNA, 23 nt, artificial
  Completely synthesized
acacgguccacagcucaucauga

SEQ ID NO: 4292 - RNA, 23 nt, artificial
  Completely synthesized
uggaagugucaaacagaaugguc

SEQ ID NO: 4293 - RNA, 23 nt, artificial
  Completely synthesized
ugauucugaaguggaagagcuag

SEQ ID NO: 4294 - RNA, 23 nt, artificial
  Completely synthesized
gugauucugaaguggaagagcua

SEQ ID NO: 4295 - RNA, 23 nt, artificial
  Completely synthesized
acuccggcauuucacuaaacaca

SEQ ID NO: 4296 - RNA, 23 nt, artificial
  Completely synthesized
guuucugaucuaucacuuugcaa

SEQ ID NO: 4297 - RNA, 23 nt, artificial
  Completely synthesized
gaucuuggaguaagucgagaagu

SEQ ID NO: 4298 - RNA, 23 nt, artificial
  Completely synthesized
uacccucaauggaaaaagaagua

SEQ ID NO: 4299 - RNA, 23 nt, artificial
  Completely synthesized
auacccucaauggaaaaagaagu

SEQ ID NO: 4300 - RNA, 23 nt, artificial
  Completely synthesized
uauacccucaauggaaaaagaag

SEQ ID NO: 4301 - RNA, 23 nt, artificial
  Completely synthesized
cuauacccucaauggaaaaagaa

SEQ ID NO: 4302 - RNA, 23 nt, artificial
  Completely synthesized
ucuauacccucaauggaaaaaga

SEQ ID NO: 4303 - RNA, 23 nt, artificial
  Completely synthesized
agacuaccaugguuccaagucca

SEQ ID NO: 4304 - RNA, 23 nt, artificial
  Completely synthesized
ccugauauucccggucacaucga

SEQ ID NO: 4305 - RNA, 23 nt, artificial
  Completely synthesized
uccugauauucccggucacaucg

SEQ ID NO: 4306 - RNA, 23 nt, artificial
  Completely synthesized
uuccugauauucccggucacauc

SEQ ID NO: 4307 - RNA, 23 nt, artificial
  Completely synthesized
guuccugauauucccggucacau

SEQ ID NO: 4308 - RNA, 23 nt, artificial
  Completely synthesized
uguuccugauauucccggucaca

SEQ ID NO: 4309 - RNA, 23 nt, artificial
  Completely synthesized
guuuguagaugacaaugagguuu

SEQ ID NO: 4310 - RNA, 23 nt, artificial
  Completely synthesized
cguuuguagaugacaaugagguu

SEQ ID NO: 4311 - RNA, 23 nt, artificial
  Completely synthesized
ccguuuguagaugacaaugaggu

SEQ ID NO: 4312 - RNA, 23 nt, artificial
  Completely synthesized
cccguuuguagaugacaaugagg

SEQ ID NO: 4313 - RNA, 23 nt, artificial
  Completely synthesized
aguggaucugccaacuacuccca

SEQ ID NO: 4314 - RNA, 23 nt, artificial
  Completely synthesized
caguggaucugccaacuacuccc

SEQ ID NO: 4315 - RNA, 23 nt, artificial
  Completely synthesized
ccaguggaucugccaacuacucc

SEQ ID NO: 4316 - RNA, 23 nt, artificial
  Completely synthesized
accaguggaucugccaacuacuc

SEQ ID NO: 4317 - RNA, 23 nt, artificial
  Completely synthesized
aaccaguggaucugccaacuacu

SEQ ID NO: 4318 - RNA, 23 nt, artificial
  Completely synthesized
gaugaagagacaggugaauuucu

SEQ ID NO: 4319 - RNA, 23 nt, artificial
  Completely synthesized
acaagagauggcaauguuuuccu

SEQ ID NO: 4320 - RNA, 23 nt, artificial
  Completely synthesized
aacaagagauggcaauguuuucc

SEQ ID NO: 4321 - RNA, 23 nt, artificial
  Completely synthesized
aaacaagagauggcaauguuuuc

SEQ ID NO: 4322 - RNA, 23 nt, artificial
  Completely synthesized
caaacaagagauggcaauguuuu

SEQ ID NO: 4323 - RNA, 23 nt, artificial
  Completely synthesized
gcaaacaagagauggcaauguuu

SEQ ID NO: 4324 - RNA, 23 nt, artificial
  Completely synthesized
cucccugcagcaaacaagagaug

SEQ ID NO: 4325 - RNA, 23 nt, artificial
  Completely synthesized
acucccugcagcaaacaagagau

SEQ ID NO: 4326 - RNA, 23 nt, artificial
  Completely synthesized
uacucccugcagcaaacaagaga

SEQ ID NO: 4327 - RNA, 23 nt, artificial
  Completely synthesized
auacucccugcagcaaacaagag

SEQ ID NO: 4328 - RNA, 23 nt, artificial
  Completely synthesized
aauacucccugcagcaaacaaga

SEQ ID NO: 4329 - RNA, 23 nt, artificial
  Completely synthesized
ccuuauucuccuagugaauacuc

SEQ ID NO: 4330 - RNA, 23 nt, artificial
  Completely synthesized
gaagauggaaaaccuuauucucc

SEQ ID NO: 4331 - RNA, 23 nt, artificial
  Completely synthesized
cucccuguuguugacuucaacga

SEQ ID NO: 4332 - RNA, 23 nt, artificial
  Completely synthesized
ccucccuguuguugacuucaacg

SEQ ID NO: 4333 - RNA, 23 nt, artificial
  Completely synthesized
accucccuguuguugacuucaac

SEQ ID NO: 4334 - RNA, 23 nt, artificial
  Completely synthesized
aaccucccuguuguugacuucaa

SEQ ID NO: 4335 - RNA, 23 nt, artificial
  Completely synthesized
ccauaucccauucccuguagaaa

SEQ ID NO: 4336 - RNA, 23 nt, artificial
  Completely synthesized
uccauaucccauucccuguagaa

SEQ ID NO: 4337 - RNA, 23 nt, artificial
  Completely synthesized
cuccauaucccauucccuguaga

SEQ ID NO: 4338 - RNA, 23 nt, artificial
  Completely synthesized
ucuccauaucccauucccuguag

SEQ ID NO: 4339 - RNA, 23 nt, artificial
  Completely synthesized
cucuccauaucccauucccugua

SEQ ID NO: 4340 - RNA, 23 nt, artificial
  Completely synthesized
gauauagaucuuggaguaagucg

SEQ ID NO: 4341 - RNA, 23 nt, artificial
  Completely synthesized
uguaguccacauuuucuuaaugc

SEQ ID NO: 4342 - RNA, 23 nt, artificial
  Completely synthesized
cuguaguccacauuuucuuaaug

SEQ ID NO: 4343 - RNA, 23 nt, artificial
  Completely synthesized
acuguaguccacauuuucuuaau

SEQ ID NO: 4344 - RNA, 23 nt, artificial
  Completely synthesized
aacuguaguccacauuuucuuaa

SEQ ID NO: 4345 - RNA, 23 nt, artificial
  Completely synthesized
uaacuguaguccacauuuucuua

SEQ ID NO: 4346 - RNA, 23 nt, artificial
  Completely synthesized
uacucaucuauacccucaaugga

SEQ ID NO: 4347 - RNA, 23 nt, artificial
  Completely synthesized
uuacucaucuauacccucaaugg

SEQ ID NO: 4348 - RNA, 23 nt, artificial
  Completely synthesized
uuuacucaucuauacccucaaug

SEQ ID NO: 4349 - RNA, 23 nt, artificial
  Completely synthesized
uuuuacucaucuauacccucaau

SEQ ID NO: 4350 - RNA, 23 nt, artificial
  Completely synthesized
uuuuuacucaucuauacccucaa

SEQ ID NO: 4351 - RNA, 23 nt, artificial
  Completely synthesized
gguuucuucggcuacguuucagu

SEQ ID NO: 4352 - RNA, 23 nt, artificial
  Completely synthesized
agguuucuucggcuacguuucag

SEQ ID NO: 4353 - RNA, 23 nt, artificial
  Completely synthesized
gagguuucuucggcuacguuuca

SEQ ID NO: 4354 - RNA, 23 nt, artificial
  Completely synthesized
ugagguuucuucggcuacguuuc

SEQ ID NO: 4355 - RNA, 23 nt, artificial
  Completely synthesized
augagguuucuucggcuacguuu

SEQ ID NO: 4356 - RNA, 23 nt, artificial
  Completely synthesized
aggugaauuucucccaauucagc

SEQ ID NO: 4357 - RNA, 23 nt, artificial
  Completely synthesized
caucuggcuaaaaagaaauuauu

SEQ ID NO: 4358 - RNA, 23 nt, artificial
  Completely synthesized
caauuucuuaggacaccauuugg

SEQ ID NO: 4359 - RNA, 23 nt, artificial
  Completely synthesized
acaauuucuuaggacaccauuug

SEQ ID NO: 4360 - RNA, 23 nt, artificial
  Completely synthesized
aacaauuucuuaggacaccauuu

SEQ ID NO: 4361 - RNA, 23 nt, artificial
  Completely synthesized
aaacaauuucuuaggacaccauu

SEQ ID NO: 4362 - RNA, 23 nt, artificial
  Completely synthesized
uaaacaauuucuuaggacaccau

SEQ ID NO: 4363 - RNA, 23 nt, artificial
  Completely synthesized
gcauuggagugucaguauguuga

SEQ ID NO: 4364 - RNA, 23 nt, artificial
  Completely synthesized
caagagauggcaauguuuuccuu

SEQ ID NO: 4365 - RNA, 23 nt, artificial
  Completely synthesized
cagcaaacaagagauggcaaugu

SEQ ID NO: 4366 - RNA, 23 nt, artificial
  Completely synthesized
gcagcaaacaagagauggcaaug

SEQ ID NO: 4367 - RNA, 23 nt, artificial
  Completely synthesized
ugcagcaaacaagagauggcaau

SEQ ID NO: 4368 - RNA, 23 nt, artificial
  Completely synthesized
cugcagcaaacaagagauggcaa

SEQ ID NO: 4369 - RNA, 23 nt, artificial
  Completely synthesized
ccugcagcaaacaagagauggca

SEQ ID NO: 4370 - RNA, 23 nt, artificial
  Completely synthesized
gagcaagauuuagaucauuugaa

SEQ ID NO: 4371 - RNA, 23 nt, artificial
  Completely synthesized
cauuaaccucccuguuguugacu

SEQ ID NO: 4372 - RNA, 23 nt, artificial
  Completely synthesized
ucauuaaccucccuguuguugac

SEQ ID NO: 4373 - RNA, 23 nt, artificial
  Completely synthesized
aucauuaaccucccuguuguuga

SEQ ID NO: 4374 - RNA, 23 nt, artificial
  Completely synthesized
aaucauuaaccucccuguuguug

SEQ ID NO: 4375 - RNA, 23 nt, artificial
  Completely synthesized
aaaucauuaaccucccuguuguu

SEQ ID NO: 4376 - RNA, 23 nt, artificial
  Completely synthesized
acuuagggcaaaagcucuccaua

SEQ ID NO: 4377 - RNA, 23 nt, artificial
  Completely synthesized
gugccccuggaagugucaaacag

SEQ ID NO: 4378 - RNA, 23 nt, artificial
  Completely synthesized
aucuauacccucaauggaaaaag

SEQ ID NO: 4379 - RNA, 23 nt, artificial
  Completely synthesized
caucuauacccucaauggaaaaa

SEQ ID NO: 4380 - RNA, 23 nt, artificial
  Completely synthesized
ucaucuauacccucaauggaaaa

SEQ ID NO: 4381 - RNA, 23 nt, artificial
  Completely synthesized
cucaucuauacccucaauggaaa

SEQ ID NO: 4382 - RNA, 23 nt, artificial
  Completely synthesized
aguccagaagccaaacugacaga

SEQ ID NO: 4383 - RNA, 23 nt, artificial
  Completely synthesized
aaguccagaagccaaacugacag

SEQ ID NO: 4384 - RNA, 23 nt, artificial
  Completely synthesized
caaguccagaagccaaacugaca

SEQ ID NO: 4385 - RNA, 23 nt, artificial
  Completely synthesized
ccaaguccagaagccaaacugac

SEQ ID NO: 4386 - RNA, 23 nt, artificial
  Completely synthesized
cacagcucaucaugauggacuug

SEQ ID NO: 4387 - RNA, 23 nt, artificial
  Completely synthesized
ccacagcucaucaugauggacuu

SEQ ID NO: 4388 - RNA, 23 nt, artificial
  Completely synthesized
uccacagcucaucaugauggacu

SEQ ID NO: 4389 - RNA, 23 nt, artificial
  Completely synthesized
guccacagcucaucaugauggac

SEQ ID NO: 4390 - RNA, 23 nt, artificial
  Completely synthesized
auuccugaguuacagugucuuaa

SEQ ID NO: 4391 - RNA, 23 nt, artificial
  Completely synthesized
cauuccugaguuacagugucuua

SEQ ID NO: 4392 - RNA, 23 nt, artificial
  Completely synthesized
ggacauugagcaaguuugggagg

SEQ ID NO: 4393 - RNA, 23 nt, artificial
  Completely synthesized
aggacauugagcaaguuugggag

SEQ ID NO: 4394 - RNA, 23 nt, artificial
  Completely synthesized
caggacauugagcaaguuuggga

SEQ ID NO: 4395 - RNA, 23 nt, artificial
  Completely synthesized
acaggacauugagcaaguuuggg

SEQ ID NO: 4396 - RNA, 23 nt, artificial
  Completely synthesized
aacaggacauugagcaaguuugg

SEQ ID NO: 4397 - RNA, 23 nt, artificial
  Completely synthesized
aaaccaguggaucugccaacuac

SEQ ID NO: 4398 - RNA, 23 nt, artificial
  Completely synthesized
gaaaccaguggaucugccaacua

SEQ ID NO: 4399 - RNA, 23 nt, artificial
  Completely synthesized
agaaaccaguggaucugccaacu

SEQ ID NO: 4400 - RNA, 23 nt, artificial
  Completely synthesized
cagaaaccaguggaucugccaac

SEQ ID NO: 4401 - RNA, 23 nt, artificial
  Completely synthesized
ucagaaaccaguggaucugccaa

SEQ ID NO: 4402 - RNA, 23 nt, artificial
  Completely synthesized
aaauuuuaagagcugguacuaau

SEQ ID NO: 4403 - RNA, 23 nt, artificial
  Completely synthesized
aucauagccaaaacuaguauaga

SEQ ID NO: 4404 - RNA, 23 nt, artificial
  Completely synthesized
aaucauagccaaaacuaguauag

SEQ ID NO: 4405 - RNA, 23 nt, artificial
  Completely synthesized
aaaucauagccaaaacuaguaua

SEQ ID NO: 4406 - RNA, 23 nt, artificial
  Completely synthesized
gugaugugaaaugcucauacuuu

SEQ ID NO: 4407 - RNA, 23 nt, artificial
  Completely synthesized
ugugaugugaaaugcucauacuu

SEQ ID NO: 4408 - RNA, 23 nt, artificial
  Completely synthesized
ccuuguucccaaaaguaagaagc

SEQ ID NO: 4409 - RNA, 23 nt, artificial
  Completely synthesized
uccuuguucccaaaaguaagaag

SEQ ID NO: 4410 - RNA, 23 nt, artificial
  Completely synthesized
uuccuuguucccaaaaguaagaa

SEQ ID NO: 4411 - RNA, 23 nt, artificial
  Completely synthesized
uuuccuuguucccaaaaguaaga

SEQ ID NO: 4412 - RNA, 23 nt, artificial
  Completely synthesized
uuuuccuuguucccaaaaguaag

SEQ ID NO: 4413 - RNA, 23 nt, artificial
  Completely synthesized
agcaaacaagagauggcaauguu

SEQ ID NO: 4414 - RNA, 23 nt, artificial
  Completely synthesized
cagcaccuuauaucucgaaguuu

SEQ ID NO: 4415 - RNA, 23 nt, artificial
  Completely synthesized
ucagcaccuuauaucucgaaguu

SEQ ID NO: 4416 - RNA, 23 nt, artificial
  Completely synthesized
cucagcaccuuauaucucgaagu

SEQ ID NO: 4417 - RNA, 23 nt, artificial
  Completely synthesized
acucagcaccuuauaucucgaag

SEQ ID NO: 4418 - RNA, 23 nt, artificial
  Completely synthesized
aacucagcaccuuauaucucgaa

SEQ ID NO: 4419 - RNA, 23 nt, artificial
  Completely synthesized
caacucagcaccuuauaucucga

SEQ ID NO: 4420 - RNA, 23 nt, artificial
  Completely synthesized
agagcacucacgugcaugaugcc

SEQ ID NO: 4421 - RNA, 23 nt, artificial
  Completely synthesized
cagagcacucacgugcaugaugc

SEQ ID NO: 4422 - RNA, 23 nt, artificial
  Completely synthesized
gcagagcacucacgugcaugaug

SEQ ID NO: 4423 - RNA, 23 nt, artificial
  Completely synthesized
ggcagagcacucacgugcaugau

SEQ ID NO: 4424 - RNA, 23 nt, artificial
  Completely synthesized
gggcagagcacucacgugcauga

SEQ ID NO: 4425 - RNA, 23 nt, artificial
  Completely synthesized
cacuuugcaaagcuuucaaccaa

SEQ ID NO: 4426 - RNA, 23 nt, artificial
  Completely synthesized
ucacuuugcaaagcuuucaacca

SEQ ID NO: 4427 - RNA, 23 nt, artificial
  Completely synthesized
aucacuuugcaaagcuuucaacc

SEQ ID NO: 4428 - RNA, 23 nt, artificial
  Completely synthesized
uaucacuuugcaaagcuuucaac

SEQ ID NO: 4429 - RNA, 23 nt, artificial
  Completely synthesized
cuaucacuuugcaaagcuuucaa

SEQ ID NO: 4430 - RNA, 23 nt, artificial
  Completely synthesized
cacagucaacacagauuuuggug

SEQ ID NO: 4431 - RNA, 23 nt, artificial
  Completely synthesized
ccacagucaacacagauuuuggu

SEQ ID NO: 4432 - RNA, 23 nt, artificial
  Completely synthesized
gccacagucaacacagauuuugg

SEQ ID NO: 4433 - RNA, 23 nt, artificial
  Completely synthesized
ugccacagucaacacagauuuug

SEQ ID NO: 4434 - RNA, 23 nt, artificial
  Completely synthesized
augccacagucaacacagauuuu

SEQ ID NO: 4435 - RNA, 23 nt, artificial
  Completely synthesized
auucagaugccacagucaacaca

SEQ ID NO: 4436 - RNA, 23 nt, artificial
  Completely synthesized
aauucagaugccacagucaacac

SEQ ID NO: 4437 - RNA, 23 nt, artificial
  Completely synthesized
aaauucagaugccacagucaaca

SEQ ID NO: 4438 - RNA, 23 nt, artificial
  Completely synthesized
uaaauucagaugccacagucaac

SEQ ID NO: 4439 - RNA, 23 nt, artificial
  Completely synthesized
uuaaauucagaugccacagucaa

SEQ ID NO: 4440 - RNA, 23 nt, artificial
  Completely synthesized
cucaauggaaaaagaaguaggua

SEQ ID NO: 4441 - RNA, 23 nt, artificial
  Completely synthesized
ccucaauggaaaaagaaguaggu

SEQ ID NO: 4442 - RNA, 23 nt, artificial
  Completely synthesized
cccucaauggaaaaagaaguagg

SEQ ID NO: 4443 - RNA, 23 nt, artificial
  Completely synthesized
acccucaauggaaaaagaaguag

SEQ ID NO: 4444 - RNA, 23 nt, artificial
  Completely synthesized
gucagaaaccaguggaucugcca

SEQ ID NO: 4445 - RNA, 23 nt, artificial
  Completely synthesized
ugaagagacaggugaauuucucc

SEQ ID NO: 4446 - RNA, 23 nt, artificial
  Completely synthesized
augaagagacaggugaauuucuc

SEQ ID NO: 4447 - RNA, 23 nt, artificial
  Completely synthesized
gggcuaguuucuguguaagugua

SEQ ID NO: 4448 - RNA, 23 nt, artificial
  Completely synthesized
guguggcaucaccagaacacuca

SEQ ID NO: 4449 - RNA, 23 nt, artificial
  Completely synthesized
aguguggcaucaccagaacacuc

SEQ ID NO: 4450 - RNA, 23 nt, artificial
  Completely synthesized
gauucugacuccggcauuucacu

SEQ ID NO: 4451 - RNA, 23 nt, artificial
  Completely synthesized
ugauucugacuccggcauuucac

SEQ ID NO: 4452 - RNA, 23 nt, artificial
  Completely synthesized
augauucugacuccggcauuuca

SEQ ID NO: 4453 - RNA, 23 nt, artificial
  Completely synthesized
aaugauucugacuccggcauuuc

SEQ ID NO: 4454 - RNA, 23 nt, artificial
  Completely synthesized
caaugauucugacuccggcauuu

SEQ ID NO: 4455 - RNA, 23 nt, artificial
  Completely synthesized
ucuaucacuuugcaaagcuuuca

SEQ ID NO: 4456 - RNA, 23 nt, artificial
  Completely synthesized
aucuaucacuuugcaaagcuuuc

SEQ ID NO: 4457 - RNA, 23 nt, artificial
  Completely synthesized
gaucuaucacuuugcaaagcuuu

SEQ ID NO: 4458 - RNA, 23 nt, artificial
  Completely synthesized
ccauucacucucugaacuucuaa

SEQ ID NO: 4459 - RNA, 23 nt, artificial
  Completely synthesized
cagaagccaaacugacagaaguu

SEQ ID NO: 4460 - RNA, 23 nt, artificial
  Completely synthesized
ccagaagccaaacugacagaagu

SEQ ID NO: 4461 - RNA, 23 nt, artificial
  Completely synthesized
uccagaagccaaacugacagaag

SEQ ID NO: 4462 - RNA, 23 nt, artificial
  Completely synthesized
guccagaagccaaacugacagaa

SEQ ID NO: 4463 - RNA, 23 nt, artificial
  Completely synthesized
cgagagcccagucuucauugcua

SEQ ID NO: 4464 - RNA, 23 nt, artificial
  Completely synthesized
uguagaugacaaugagguuucuu

SEQ ID NO: 4465 - RNA, 23 nt, artificial
  Completely synthesized
uuguagaugacaaugagguuucu

SEQ ID NO: 4466 - RNA, 23 nt, artificial
  Completely synthesized
uuuguagaugacaaugagguuuc

SEQ ID NO: 4467 - RNA, 23 nt, artificial
  Completely synthesized
cuuuaaaaagcauuggaguguca

SEQ ID NO: 4468 - RNA, 23 nt, artificial
  Completely synthesized
acuuuaaaaagcauuggaguguc

SEQ ID NO: 4469 - RNA, 23 nt, artificial
  Completely synthesized
aacuuuaaaaagcauuggagugu

SEQ ID NO: 4470 - RNA, 23 nt, artificial
  Completely synthesized
aaacuuuaaaaagcauuggagug

SEQ ID NO: 4471 - RNA, 23 nt, artificial
  Completely synthesized
gaaacuuuaaaaagcauuggagu

SEQ ID NO: 4472 - RNA, 23 nt, artificial
  Completely synthesized
ugcauuaauucgggauauacgua

SEQ ID NO: 4473 - RNA, 23 nt, artificial
  Completely synthesized
uugcauuaauucgggauauacgu

SEQ ID NO: 4474 - RNA, 23 nt, artificial
  Completely synthesized
cuugcauuaauucgggauauacg

SEQ ID NO: 4475 - RNA, 23 nt, artificial
  Completely synthesized
acuugcauuaauucgggauauac

SEQ ID NO: 4476 - RNA, 23 nt, artificial
  Completely synthesized
aacuugcauuaauucgggauaua

SEQ ID NO: 4477 - RNA, 23 nt, artificial
  Completely synthesized
aacacaccagagaaagaauugcc

SEQ ID NO: 4478 - RNA, 23 nt, artificial
  Completely synthesized
ucagcgacggaaagaguaugagc

SEQ ID NO: 4479 - RNA, 23 nt, artificial
  Completely synthesized
cgagaaguauuugacuucaguca

SEQ ID NO: 4480 - RNA, 23 nt, artificial
  Completely synthesized
ucgagaaguauuugacuucaguc

SEQ ID NO: 4481 - RNA, 23 nt, artificial
  Completely synthesized
gucgagaaguauuugacuucagu

SEQ ID NO: 4482 - RNA, 23 nt, artificial
  Completely synthesized
agucgagaaguauuugacuucag

SEQ ID NO: 4483 - RNA, 23 nt, artificial
  Completely synthesized
aagucgagaaguauuugacuuca

SEQ ID NO: 4484 - RNA, 23 nt, artificial
  Completely synthesized
gaugccacagucaacacagauuu

SEQ ID NO: 4485 - RNA, 23 nt, artificial
  Completely synthesized
auuaaauucagaugccacaguca

SEQ ID NO: 4486 - RNA, 23 nt, artificial
  Completely synthesized
gaaguagguaacuguaguccaca

SEQ ID NO: 4487 - RNA, 23 nt, artificial
  Completely synthesized
aagcugguugagacuaccauggu

SEQ ID NO: 4488 - RNA, 23 nt, artificial
  Completely synthesized
caagcugguugagacuaccaugg

SEQ ID NO: 4489 - RNA, 23 nt, artificial
  Completely synthesized
acaagcugguugagacuaccaug

SEQ ID NO: 4490 - RNA, 23 nt, artificial
  Completely synthesized
uauccauuccugaguuacagugu

SEQ ID NO: 4491 - RNA, 23 nt, artificial
  Completely synthesized
uuauccauuccugaguuacagug

SEQ ID NO: 4492 - RNA, 23 nt, artificial
  Completely synthesized
auuauccauuccugaguuacagu

SEQ ID NO: 4493 - RNA, 23 nt, artificial
  Completely synthesized
uauuauccauuccugaguuacag

SEQ ID NO: 4494 - RNA, 23 nt, artificial
  Completely synthesized
cuauuauccauuccugaguuaca

SEQ ID NO: 4495 - RNA, 23 nt, artificial
  Completely synthesized
gacauacuuuggaggcaagauau

SEQ ID NO: 4496 - RNA, 23 nt, artificial
  Completely synthesized
agaugacaaugagguuucuucgg

SEQ ID NO: 4497 - RNA, 23 nt, artificial
  Completely synthesized
uagaugacaaugagguuucuucg

SEQ ID NO: 4498 - RNA, 23 nt, artificial
  Completely synthesized
guagaugacaaugagguuucuuc

SEQ ID NO: 4499 - RNA, 23 nt, artificial
  Completely synthesized
ggauuugaccuuuucugagcuag

SEQ ID NO: 4500 - RNA, 23 nt, artificial
  Completely synthesized
aggauuugaccuuuucugagcua

SEQ ID NO: 4501 - RNA, 23 nt, artificial
  Completely synthesized
gaggauuugaccuuuucugagcu

SEQ ID NO: 4502 - RNA, 23 nt, artificial
  Completely synthesized
gaauugcagaaaaagaaaacugg

SEQ ID NO: 4503 - RNA, 23 nt, artificial
  Completely synthesized
guccuaaaacaccaguacauucu

SEQ ID NO: 4504 - RNA, 23 nt, artificial
  Completely synthesized
gguccuaaaacaccaguacauuc

SEQ ID NO: 4505 - RNA, 23 nt, artificial
  Completely synthesized
ugguccuaaaacaccaguacauu

SEQ ID NO: 4506 - RNA, 23 nt, artificial
  Completely synthesized
augguccuaaaacaccaguacau

SEQ ID NO: 4507 - RNA, 23 nt, artificial
  Completely synthesized
aaugguccuaaaacaccaguaca

SEQ ID NO: 4508 - RNA, 23 nt, artificial
  Completely synthesized
ugagcccaguaucagcaacagca

SEQ ID NO: 4509 - RNA, 23 nt, artificial
  Completely synthesized
ucuuaaugcuuuugaggauuccu

SEQ ID NO: 4510 - RNA, 23 nt, artificial
  Completely synthesized
uucuuaaugcuuuugaggauucc

SEQ ID NO: 4511 - RNA, 23 nt, artificial
  Completely synthesized
uuucuuaaugcuuuugaggauuc

SEQ ID NO: 4512 - RNA, 23 nt, artificial
  Completely synthesized
uuuucuuaaugcuuuugaggauu

SEQ ID NO: 4513 - RNA, 23 nt, artificial
  Completely synthesized
auuuucuuaaugcuuuugaggau

SEQ ID NO: 4514 - RNA, 23 nt, artificial
  Completely synthesized
acucaucuauacccucaauggaa

SEQ ID NO: 4515 - RNA, 23 nt, artificial
  Completely synthesized
agaagccaaacugacagaaguug

SEQ ID NO: 4516 - RNA, 23 nt, artificial
  Completely synthesized
uuuggaggcaagauauagaucuu

SEQ ID NO: 4517 - RNA, 23 nt, artificial
  Completely synthesized
cuuuggaggcaagauauagaucu

SEQ ID NO: 4518 - RNA, 23 nt, artificial
  Completely synthesized
ggcucagucaccugaaacuucug

SEQ ID NO: 4519 - RNA, 23 nt, artificial
  Completely synthesized
aggcucagucaccugaaacuucu

SEQ ID NO: 4520 - RNA, 23 nt, artificial
  Completely synthesized
agaugcuuuguacuuugaugacu

SEQ ID NO: 4521 - RNA, 23 nt, artificial
  Completely synthesized
gcugguacuaauaaaggauuauu

SEQ ID NO: 4522 - RNA, 23 nt, artificial
  Completely synthesized
augaugauaugacaucuggcuaa

SEQ ID NO: 4523 - RNA, 23 nt, artificial
  Completely synthesized
cuguguaaguguaaauacuacaa

SEQ ID NO: 4524 - RNA, 23 nt, artificial
  Completely synthesized
ucuguguaaguguaaauacuaca

SEQ ID NO: 4525 - RNA, 23 nt, artificial
  Completely synthesized
uucuguguaaguguaaauacuac

SEQ ID NO: 4526 - RNA, 23 nt, artificial
  Completely synthesized
uuucuguguaaguguaaauacua

SEQ ID NO: 4527 - RNA, 23 nt, artificial
  Completely synthesized
ccauuugggcuaguuucugugua

SEQ ID NO: 4528 - RNA, 23 nt, artificial
  Completely synthesized
accauuugggcuaguuucugugu

SEQ ID NO: 4529 - RNA, 23 nt, artificial
  Completely synthesized
caccauuugggcuaguuucugug

SEQ ID NO: 4530 - RNA, 23 nt, artificial
  Completely synthesized
acaccauuugggcuaguuucugu

SEQ ID NO: 4531 - RNA, 23 nt, artificial
  Completely synthesized
agcauuggagugucaguauguug

SEQ ID NO: 4532 - RNA, 23 nt, artificial
  Completely synthesized
aagcauuggagugucaguauguu

SEQ ID NO: 4533 - RNA, 23 nt, artificial
  Completely synthesized
aaagcauuggagugucaguaugu

SEQ ID NO: 4534 - RNA, 23 nt, artificial
  Completely synthesized
aaaacuagauuuaggaggauuug

SEQ ID NO: 4535 - RNA, 23 nt, artificial
  Completely synthesized
aaaaacuagauuuaggaggauuu

SEQ ID NO: 4536 - RNA, 23 nt, artificial
  Completely synthesized
gaaaaacuagauuuaggaggauu

SEQ ID NO: 4537 - RNA, 23 nt, artificial
  Completely synthesized
agaaaaacuagauuuaggaggau

SEQ ID NO: 4538 - RNA, 23 nt, artificial
  Completely synthesized
aagaaaaacuagauuuaggagga

SEQ ID NO: 4539 - RNA, 23 nt, artificial
  Completely synthesized
caaaaguaagaagccagauguua

SEQ ID NO: 4540 - RNA, 23 nt, artificial
  Completely synthesized
caacuugcauuaauucgggauau

SEQ ID NO: 4541 - RNA, 23 nt, artificial
  Completely synthesized
ucaacuugcauuaauucgggaua

SEQ ID NO: 4542 - RNA, 23 nt, artificial
  Completely synthesized
aaaagcucuccauaucccauucc

SEQ ID NO: 4543 - RNA, 23 nt, artificial
  Completely synthesized
caaaagcucuccauaucccauuc

SEQ ID NO: 4544 - RNA, 23 nt, artificial
  Completely synthesized
gcaaaagcucuccauaucccauu

SEQ ID NO: 4545 - RNA, 23 nt, artificial
  Completely synthesized
ggcaaaagcucuccauaucccau

SEQ ID NO: 4546 - RNA, 23 nt, artificial
  Completely synthesized
aguggaaucuuccagcuauggag

SEQ ID NO: 4547 - RNA, 23 nt, artificial
  Completely synthesized
caguggaaucuuccagcuaugga

SEQ ID NO: 4548 - RNA, 23 nt, artificial
  Completely synthesized
ucaguggaaucuuccagcuaugg

SEQ ID NO: 4549 - RNA, 23 nt, artificial
  Completely synthesized
cucaguggaaucuuccagcuaug

SEQ ID NO: 4550 - RNA, 23 nt, artificial
  Completely synthesized
acucaguggaaucuuccagcuau

SEQ ID NO: 4551 - RNA, 23 nt, artificial
  Completely synthesized
cacucaguggaaucuuccagcua

SEQ ID NO: 4552 - RNA, 23 nt, artificial
  Completely synthesized
acacucaguggaaucuuccagcu

SEQ ID NO: 4553 - RNA, 23 nt, artificial
  Completely synthesized
aacacucaguggaaucuuccagc

SEQ ID NO: 4554 - RNA, 23 nt, artificial
  Completely synthesized
gaacacucaguggaaucuuccag

SEQ ID NO: 4555 - RNA, 23 nt, artificial
  Completely synthesized
agaacacucaguggaaucuucca

SEQ ID NO: 4556 - RNA, 23 nt, artificial
  Completely synthesized
ucaaugauucugacuccggcauu

SEQ ID NO: 4557 - RNA, 23 nt, artificial
  Completely synthesized
uucaaugauucugacuccggcau

SEQ ID NO: 4558 - RNA, 23 nt, artificial
  Completely synthesized
auucaaugauucugacuccggca

SEQ ID NO: 4559 - RNA, 23 nt, artificial
  Completely synthesized
aauucaaugauucugacuccggc

SEQ ID NO: 4560 - RNA, 23 nt, artificial
  Completely synthesized
ucuaaaugggcccauugauguuu

SEQ ID NO: 4561 - RNA, 23 nt, artificial
  Completely synthesized
uucuaaaugggcccauugauguu

SEQ ID NO: 4562 - RNA, 23 nt, artificial
  Completely synthesized
cuucuaaaugggcccauugaugu

SEQ ID NO: 4563 - RNA, 23 nt, artificial
  Completely synthesized
acuucuaaaugggcccauugaug

SEQ ID NO: 4564 - RNA, 23 nt, artificial
  Completely synthesized
aacuucuaaaugggcccauugau

SEQ ID NO: 4565 - RNA, 23 nt, artificial
  Completely synthesized
gucaacacagauuuuggugauga

SEQ ID NO: 4566 - RNA, 23 nt, artificial
  Completely synthesized
agucaacacagauuuuggugaug

SEQ ID NO: 4567 - RNA, 23 nt, artificial
  Completely synthesized
cagucaacacagauuuuggugau

SEQ ID NO: 4568 - RNA, 23 nt, artificial
  Completely synthesized
uggaggcaagauauagaucuugg

SEQ ID NO: 4569 - RNA, 23 nt, artificial
  Completely synthesized
uuggaggcaagauauagaucuug

SEQ ID NO: 4570 - RNA, 23 nt, artificial
  Completely synthesized
cuaaucaggcucagucaccugaa

SEQ ID NO: 4571 - RNA, 23 nt, artificial
  Completely synthesized
cuucauugcuacuaaucaggcuc

SEQ ID NO: 4572 - RNA, 23 nt, artificial
  Completely synthesized
ucuucauugcuacuaaucaggcu

SEQ ID NO: 4573 - RNA, 23 nt, artificial
  Completely synthesized
gucuucauugcuacuaaucaggc

SEQ ID NO: 4574 - RNA, 23 nt, artificial
  Completely synthesized
gugaauuucucccaauucagcca

SEQ ID NO: 4575 - RNA, 23 nt, artificial
  Completely synthesized
ggugaauuucucccaauucagcc

SEQ ID NO: 4576 - RNA, 23 nt, artificial
  Completely synthesized
guauguugaaucaguaguuucac

SEQ ID NO: 4577 - RNA, 23 nt, artificial
  Completely synthesized
aguauguugaaucaguaguuuca

SEQ ID NO: 4578 - RNA, 23 nt, artificial
  Completely synthesized
caguauguugaaucaguaguuuc

SEQ ID NO: 4579 - RNA, 23 nt, artificial
  Completely synthesized
aaaaagcauuggagugucaguau

SEQ ID NO: 4580 - RNA, 23 nt, artificial
  Completely synthesized
uaaaaagcauuggagugucagua

SEQ ID NO: 4581 - RNA, 23 nt, artificial
  Completely synthesized
uuaaaaagcauuggagugucagu

SEQ ID NO: 4582 - RNA, 23 nt, artificial
  Completely synthesized
uuuaaaaagcauuggagugucag

SEQ ID NO: 4583 - RNA, 23 nt, artificial
  Completely synthesized
uguuuuccuuguucccaaaagua

SEQ ID NO: 4584 - RNA, 23 nt, artificial
  Completely synthesized
auguuuuccuuguucccaaaagu

SEQ ID NO: 4585 - RNA, 23 nt, artificial
  Completely synthesized
aauguuuuccuuguucccaaaag

SEQ ID NO: 4586 - RNA, 23 nt, artificial
  Completely synthesized
caauguuuuccuuguucccaaaa

SEQ ID NO: 4587 - RNA, 23 nt, artificial
  Completely synthesized
gcaauguuuuccuuguucccaaa

SEQ ID NO: 4588 - RNA, 23 nt, artificial
  Completely synthesized
cccugcagcaaacaagagauggc

SEQ ID NO: 4589 - RNA, 23 nt, artificial
  Completely synthesized
ucccugcagcaaacaagagaugg

SEQ ID NO: 4590 - RNA, 23 nt, artificial
  Completely synthesized
cgugaugaagauggaaaaccuua

SEQ ID NO: 4591 - RNA, 23 nt, artificial
  Completely synthesized
agaugccacagucaacacagauu

SEQ ID NO: 4592 - RNA, 23 nt, artificial
  Completely synthesized
uuuuucgcucaguuacaacuaga

SEQ ID NO: 4593 - RNA, 23 nt, artificial
  Completely synthesized
cuuuuucgcucaguuacaacuag

SEQ ID NO: 4594 - RNA, 23 nt, artificial
  Completely synthesized
caacuccaaaaggagcaagagaa

SEQ ID NO: 4595 - RNA, 23 nt, artificial
  Completely synthesized
ccuuuucugagcuaguuuuuuug

SEQ ID NO: 4596 - RNA, 23 nt, artificial
  Completely synthesized
accuuuucugagcuaguuuuuuu

SEQ ID NO: 4597 - RNA, 23 nt, artificial
  Completely synthesized
gaccuuuucugagcuaguuuuuu

SEQ ID NO: 4598 - RNA, 23 nt, artificial
  Completely synthesized
ugaccuuuucugagcuaguuuuu

SEQ ID NO: 4599 - RNA, 23 nt, artificial
  Completely synthesized
uugaccuuuucugagcuaguuuu

SEQ ID NO: 4600 - RNA, 23 nt, artificial
  Completely synthesized
agauggcaauguuuuccuuguuc

SEQ ID NO: 4601 - RNA, 23 nt, artificial
  Completely synthesized
gagauggcaauguuuuccuuguu

SEQ ID NO: 4602 - RNA, 23 nt, artificial
  Completely synthesized
agagauggcaauguuuuccuugu

SEQ ID NO: 4603 - RNA, 23 nt, artificial
  Completely synthesized
aagagauggcaauguuuuccuug

SEQ ID NO: 4604 - RNA, 23 nt, artificial
  Completely synthesized
aacaacucagcaccuuauaucuc

SEQ ID NO: 4605 - RNA, 23 nt, artificial
  Completely synthesized
aaacaacucagcaccuuauaucu

SEQ ID NO: 4606 - RNA, 23 nt, artificial
  Completely synthesized
ucacaagagaugaacuuagggca

SEQ ID NO: 4607 - RNA, 23 nt, artificial
  Completely synthesized
gacaaacauucaagccgcuugga

SEQ ID NO: 4608 - RNA, 23 nt, artificial
  Completely synthesized
agacaaacauucaagccgcuugg

SEQ ID NO: 4609 - RNA, 23 nt, artificial
  Completely synthesized
aagacaaacauucaagccgcuug

SEQ ID NO: 4610 - RNA, 23 nt, artificial
  Completely synthesized
aaagacaaacauucaagccgcuu

SEQ ID NO: 4611 - RNA, 23 nt, artificial
  Completely synthesized
aaaagacaaacauucaagccgcu

SEQ ID NO: 4612 - RNA, 23 nt, artificial
  Completely synthesized
gcgacggaaagaguaugagcugg

SEQ ID NO: 4613 - RNA, 23 nt, artificial
  Completely synthesized
agcgacggaaagaguaugagcug

SEQ ID NO: 4614 - RNA, 23 nt, artificial
  Completely synthesized
cagcgacggaaagaguaugagcu

SEQ ID NO: 4615 - RNA, 23 nt, artificial
  Completely synthesized
ccaaugugagaacacaccagaga

SEQ ID NO: 4616 - RNA, 23 nt, artificial
  Completely synthesized
cccaaugugagaacacaccagag

SEQ ID NO: 4617 - RNA, 23 nt, artificial
  Completely synthesized
gcccaaugugagaacacaccaga

SEQ ID NO: 4618 - RNA, 23 nt, artificial
  Completely synthesized
ugcccaaugugagaacacaccag

SEQ ID NO: 4619 - RNA, 23 nt, artificial
  Completely synthesized
augcccaaugugagaacacacca

SEQ ID NO: 4620 - RNA, 23 nt, artificial
  Completely synthesized
ggaagugucaaacagaauggucc

SEQ ID NO: 4621 - RNA, 23 nt, artificial
  Completely synthesized
cuacuuuaagccauucacucucu

SEQ ID NO: 4622 - RNA, 23 nt, artificial
  Completely synthesized
gcuacuuuaagccauucacucuc

SEQ ID NO: 4623 - RNA, 23 nt, artificial
  Completely synthesized
ugcuacuuuaagccauucacucu

SEQ ID NO: 4624 - RNA, 23 nt, artificial
  Completely synthesized
cugcuacuuuaagccauucacuc

SEQ ID NO: 4625 - RNA, 23 nt, artificial
  Completely synthesized
cugagcccaguaucagcaacagc

SEQ ID NO: 4626 - RNA, 23 nt, artificial
  Completely synthesized
gcugagcccaguaucagcaacag

SEQ ID NO: 4627 - RNA, 23 nt, artificial
  Completely synthesized
agcugagcccaguaucagcaaca

SEQ ID NO: 4628 - RNA, 23 nt, artificial
  Completely synthesized
caaacugacagaaguugacaauu

SEQ ID NO: 4629 - RNA, 23 nt, artificial
  Completely synthesized
cauugagcaaguuugggaggagc

SEQ ID NO: 4630 - RNA, 23 nt, artificial
  Completely synthesized
acauugagcaaguuugggaggag

SEQ ID NO: 4631 - RNA, 23 nt, artificial
  Completely synthesized
gacauugagcaaguuugggagga

SEQ ID NO: 4632 - RNA, 23 nt, artificial
  Completely synthesized
gaaucaguaguuucacuuuaacu

SEQ ID NO: 4633 - RNA, 23 nt, artificial
  Completely synthesized
ugaaucaguaguuucacuuuaac

SEQ ID NO: 4634 - RNA, 23 nt, artificial
  Completely synthesized
uugaaucaguaguuucacuuuaa

SEQ ID NO: 4635 - RNA, 23 nt, artificial
  Completely synthesized
guugaaucaguaguuucacuuua

SEQ ID NO: 4636 - RNA, 23 nt, artificial
  Completely synthesized
uguugaaucaguaguuucacuuu

SEQ ID NO: 4637 - RNA, 23 nt, artificial
  Completely synthesized
aaaagcauuggagugucaguaug

SEQ ID NO: 4638 - RNA, 23 nt, artificial
  Completely synthesized
uuugaccuuuucugagcuaguuu

SEQ ID NO: 4639 - RNA, 23 nt, artificial
  Completely synthesized
auuugaccuuuucugagcuaguu

SEQ ID NO: 4640 - RNA, 23 nt, artificial
  Completely synthesized
gauuugaccuuuucugagcuagu

SEQ ID NO: 4641 - RNA, 23 nt, artificial
  Completely synthesized
acaacucagcaccuuauaucucg

SEQ ID NO: 4642 - RNA, 23 nt, artificial
  Completely synthesized
gacaaaagccuucaccuacugaa

SEQ ID NO: 4643 - RNA, 23 nt, artificial
  Completely synthesized
ugacaaaagccuucaccuacuga

SEQ ID NO: 4644 - RNA, 23 nt, artificial
  Completely synthesized
augacaaaagccuucaccuacug

SEQ ID NO: 4645 - RNA, 23 nt, artificial
  Completely synthesized
aaugacaaaagccuucaccuacu

SEQ ID NO: 4646 - RNA, 23 nt, artificial
  Completely synthesized
cucaaagaaaaaggagaaaauga

SEQ ID NO: 4647 - RNA, 23 nt, artificial
  Completely synthesized
gcaagauuuagaucauuugaaag

SEQ ID NO: 4648 - RNA, 23 nt, artificial
  Completely synthesized
agcaagauuuagaucauuugaaa

SEQ ID NO: 4649 - RNA, 23 nt, artificial
  Completely synthesized
aaaguggcugcucagaauugcag

SEQ ID NO: 4650 - RNA, 23 nt, artificial
  Completely synthesized
agugauucugaaguggaagagcu

SEQ ID NO: 4651 - RNA, 23 nt, artificial
  Completely synthesized
auucugacuccggcauuucacua

SEQ ID NO: 4652 - RNA, 23 nt, artificial
  Completely synthesized
acagcucaucaugauggacuugg

SEQ ID NO: 4653 - RNA, 23 nt, artificial
  Completely synthesized
cagaauucaaugauucugacucc

SEQ ID NO: 4654 - RNA, 23 nt, artificial
  Completely synthesized
gcagaauucaaugauucugacuc

SEQ ID NO: 4655 - RNA, 23 nt, artificial
  Completely synthesized
agcagaauucaaugauucugacu

SEQ ID NO: 4656 - RNA, 23 nt, artificial
  Completely synthesized
cagcagaauucaaugauucugac

SEQ ID NO: 4657 - RNA, 23 nt, artificial
  Completely synthesized
uguuucugaucuaucacuuugca

SEQ ID NO: 4658 - RNA, 23 nt, artificial
  Completely synthesized
auguuucugaucuaucacuuugc

SEQ ID NO: 4659 - RNA, 23 nt, artificial
  Completely synthesized
gauguuucugaucuaucacuuug

SEQ ID NO: 4660 - RNA, 23 nt, artificial
  Completely synthesized
gccauucacucucugaacuucua

SEQ ID NO: 4661 - RNA, 23 nt, artificial
  Completely synthesized
uagcugagcccaguaucagcaac

SEQ ID NO: 4662 - RNA, 23 nt, artificial
  Completely synthesized
auagcugagcccaguaucagcaa

SEQ ID NO: 4663 - RNA, 23 nt, artificial
  Completely synthesized
ucauuaaauucagaugccacagu

SEQ ID NO: 4664 - RNA, 23 nt, artificial
  Completely synthesized
cucauuaaauucagaugccacag

SEQ ID NO: 4665 - RNA, 23 nt, artificial
  Completely synthesized
acucauuaaauucagaugccaca

SEQ ID NO: 4666 - RNA, 23 nt, artificial
  Completely synthesized
aacucauuaaauucagaugccac

SEQ ID NO: 4667 - RNA, 23 nt, artificial
  Completely synthesized
gaacucauuaaauucagaugcca

SEQ ID NO: 4668 - RNA, 23 nt, artificial
  Completely synthesized
guaguccacauuuucuuaaugcu

SEQ ID NO: 4669 - RNA, 23 nt, artificial
  Completely synthesized
cugaaacuucuguugcucaggua

SEQ ID NO: 4670 - RNA, 23 nt, artificial
  Completely synthesized
ccugaaacuucuguugcucaggu

SEQ ID NO: 4671 - RNA, 23 nt, artificial
  Completely synthesized
accugaaacuucuguugcucagg

SEQ ID NO: 4672 - RNA, 23 nt, artificial
  Completely synthesized
caccugaaacuucuguugcucag

SEQ ID NO: 4673 - RNA, 23 nt, artificial
  Completely synthesized
ucaccugaaacuucuguugcuca

SEQ ID NO: 4674 - RNA, 23 nt, artificial
  Completely synthesized
cauugcuacuaaucaggcucagu

SEQ ID NO: 4675 - RNA, 23 nt, artificial
  Completely synthesized
ucauugcuacuaaucaggcucag

SEQ ID NO: 4676 - RNA, 23 nt, artificial
  Completely synthesized
uucauugcuacuaaucaggcuca

SEQ ID NO: 4677 - RNA, 23 nt, artificial
  Completely synthesized
gagcccagucuucauugcuacua

SEQ ID NO: 4678 - RNA, 23 nt, artificial
  Completely synthesized
agagcccagucuucauugcuacu

SEQ ID NO: 4679 - RNA, 23 nt, artificial
  Completely synthesized
gagagcccagucuucauugcuac

SEQ ID NO: 4680 - RNA, 23 nt, artificial
  Completely synthesized
uuucagucacuuguuccugauau

SEQ ID NO: 4681 - RNA, 23 nt, artificial
  Completely synthesized
guuucagucacuuguuccugaua

SEQ ID NO: 4682 - RNA, 23 nt, artificial
  Completely synthesized
cuacguuucagucacuuguuccu

SEQ ID NO: 4683 - RNA, 23 nt, artificial
  Completely synthesized
gcuacguuucagucacuuguucc

SEQ ID NO: 4684 - RNA, 23 nt, artificial
  Completely synthesized
ggcuacguuucagucacuuguuc

SEQ ID NO: 4685 - RNA, 23 nt, artificial
  Completely synthesized
gucccagcaggacauggauuuga

SEQ ID NO: 4686 - RNA, 23 nt, artificial
  Completely synthesized
ggacaaaaaauggcauuuuuuau

SEQ ID NO: 4687 - RNA, 23 nt, artificial
  Completely synthesized
uggacaaaaaauggcauuuuuua

SEQ ID NO: 4688 - RNA, 23 nt, artificial
  Completely synthesized
auggacaaaaaauggcauuuuuu

SEQ ID NO: 4689 - RNA, 23 nt, artificial
  Completely synthesized
uauggacaaaaaauggcauuuuu

SEQ ID NO: 4690 - RNA, 23 nt, artificial
  Completely synthesized
acaacuccaaaaggagcaagaga

SEQ ID NO: 4691 - RNA, 23 nt, artificial
  Completely synthesized
guuuuccuuguucccaaaaguaa

SEQ ID NO: 4692 - RNA, 23 nt, artificial
  Completely synthesized
aaaugacaaaagccuucaccuac

SEQ ID NO: 4693 - RNA, 23 nt, artificial
  Completely synthesized
aaaaugacaaaagccuucaccua

SEQ ID NO: 4694 - RNA, 23 nt, artificial
  Completely synthesized
gaaaaugacaaaagccuucaccu

SEQ ID NO: 4695 - RNA, 23 nt, artificial
  Completely synthesized
ucaucucacaagagaugaacuua

SEQ ID NO: 4696 - RNA, 23 nt, artificial
  Completely synthesized
cucaucucacaagagaugaacuu

SEQ ID NO: 4697 - RNA, 23 nt, artificial
  Completely synthesized
gcucaucucacaagagaugaacu

SEQ ID NO: 4698 - RNA, 23 nt, artificial
  Completely synthesized
acuacuuggccucagugauucug

SEQ ID NO: 4699 - RNA, 23 nt, artificial
  Completely synthesized
cacuacuuggccucagugauucu

SEQ ID NO: 4700 - RNA, 23 nt, artificial
  Completely synthesized
acacuacuuggccucagugauuc

SEQ ID NO: 4701 - RNA, 23 nt, artificial
  Completely synthesized
cacacuacuuggccucagugauu

SEQ ID NO: 4702 - RNA, 23 nt, artificial
  Completely synthesized
acacacuacuuggccucagugau

SEQ ID NO: 4703 - RNA, 23 nt, artificial
  Completely synthesized
agaaguauuugacuucagucagc

SEQ ID NO: 4704 - RNA, 23 nt, artificial
  Completely synthesized
gagaaguauuugacuucagucag

SEQ ID NO: 4705 - RNA, 23 nt, artificial
  Completely synthesized
cauuaaauucagaugccacaguc

SEQ ID NO: 4706 - RNA, 23 nt, artificial
  Completely synthesized
gcuuuugaggauuccuucagcag

SEQ ID NO: 4707 - RNA, 23 nt, artificial
  Completely synthesized
ugcuuuugaggauuccuucagca

SEQ ID NO: 4708 - RNA, 23 nt, artificial
  Completely synthesized
augcuuuugaggauuccuucagc

SEQ ID NO: 4709 - RNA, 23 nt, artificial
  Completely synthesized
aaugcuuuugaggauuccuucag

SEQ ID NO: 4710 - RNA, 23 nt, artificial
  Completely synthesized
uaaugcuuuugaggauuccuuca

SEQ ID NO: 4711 - RNA, 23 nt, artificial
  Completely synthesized
guaacuguaguccacauuuucuu

SEQ ID NO: 4712 - RNA, 23 nt, artificial
  Completely synthesized
gguaugcaacaggacauugagca

SEQ ID NO: 4713 - RNA, 23 nt, artificial
  Completely synthesized
cgguaugcaacaggacauugagc

SEQ ID NO: 4714 - RNA, 23 nt, artificial
  Completely synthesized
acgguaugcaacaggacauugag

SEQ ID NO: 4715 - RNA, 23 nt, artificial
  Completely synthesized
cugauauucccggucacaucgag

SEQ ID NO: 4716 - RNA, 23 nt, artificial
  Completely synthesized
acauccagucagaaaccagugga

SEQ ID NO: 4717 - RNA, 23 nt, artificial
  Completely synthesized
cacauccagucagaaaccagugg

SEQ ID NO: 4718 - RNA, 23 nt, artificial
  Completely synthesized
gcacauccagucagaaaccagug

SEQ ID NO: 4719 - RNA, 23 nt, artificial
  Completely synthesized
agcacauccagucagaaaccagu

SEQ ID NO: 4720 - RNA, 23 nt, artificial
  Completely synthesized
gagcuaguuuuuuuguacuauua

SEQ ID NO: 4721 - RNA, 23 nt, artificial
  Completely synthesized
ugagcuaguuuuuuuguacuauu

SEQ ID NO: 4722 - RNA, 23 nt, artificial
  Completely synthesized
guuuucagcaugcuacgugauga

SEQ ID NO: 4723 - RNA, 23 nt, artificial
  Completely synthesized
aguuuucagcaugcuacgugaug

SEQ ID NO: 4724 - RNA, 23 nt, artificial
  Completely synthesized
aaguuuucagcaugcuacgugau

SEQ ID NO: 4725 - RNA, 23 nt, artificial
  Completely synthesized
gaaguuuucagcaugcuacguga

SEQ ID NO: 4726 - RNA, 23 nt, artificial
  Completely synthesized
caucaugauggacuuggagcugc

SEQ ID NO: 4727 - RNA, 23 nt, artificial
  Completely synthesized
agaauugccuguaaguccugguc

SEQ ID NO: 4728 - RNA, 23 nt, artificial
  Completely synthesized
aagaauugccuguaaguccuggu

SEQ ID NO: 4729 - RNA, 23 nt, artificial
  Completely synthesized
aaagaauugccuguaaguccugg

SEQ ID NO: 4730 - RNA, 23 nt, artificial
  Completely synthesized
guacaacccuugucaccaucuca

SEQ ID NO: 4731 - RNA, 23 nt, artificial
  Completely synthesized
gguacaacccuugucaccaucuc

SEQ ID NO: 4732 - RNA, 23 nt, artificial
  Completely synthesized
ugguacaacccuugucaccaucu

SEQ ID NO: 4733 - RNA, 23 nt, artificial
  Completely synthesized
augguacaacccuugucaccauc

SEQ ID NO: 4734 - RNA, 23 nt, artificial
  Completely synthesized
uaugguacaacccuugucaccau

SEQ ID NO: 4735 - RNA, 23 nt, artificial
  Completely synthesized
aaccacccugaaagcacagcaga

SEQ ID NO: 4736 - RNA, 23 nt, artificial
  Completely synthesized
aagccauucacucucugaacuuc

SEQ ID NO: 4737 - RNA, 23 nt, artificial
  Completely synthesized
uaagccauucacucucugaacuu

SEQ ID NO: 4738 - RNA, 23 nt, artificial
  Completely synthesized
uuaagccauucacucucugaacu

SEQ ID NO: 4739 - RNA, 23 nt, artificial
  Completely synthesized
uuuaagccauucacucucugaac

SEQ ID NO: 4740 - RNA, 23 nt, artificial
  Completely synthesized
cuuuaagccauucacucucugaa

SEQ ID NO: 4741 - RNA, 23 nt, artificial
  Completely synthesized
cauagcugagcccaguaucagca

SEQ ID NO: 4742 - RNA, 23 nt, artificial
  Completely synthesized
ucauagcugagcccaguaucagc

SEQ ID NO: 4743 - RNA, 23 nt, artificial
  Completely synthesized
uucauagcugagcccaguaucag

SEQ ID NO: 4744 - RNA, 23 nt, artificial
  Completely synthesized
uuucauagcugagcccaguauca

SEQ ID NO: 4745 - RNA, 23 nt, artificial
  Completely synthesized
acagucaacacagauuuugguga

SEQ ID NO: 4746 - RNA, 23 nt, artificial
  Completely synthesized
cagaugccacagucaacacagau

SEQ ID NO: 4747 - RNA, 23 nt, artificial
  Completely synthesized
ucagaugccacagucaacacaga

SEQ ID NO: 4748 - RNA, 23 nt, artificial
  Completely synthesized
ugacaagcugguugagacuacca

SEQ ID NO: 4749 - RNA, 23 nt, artificial
  Completely synthesized
augacaagcugguugagacuacc

SEQ ID NO: 4750 - RNA, 23 nt, artificial
  Completely synthesized
aaugacaagcugguugagacuac

SEQ ID NO: 4751 - RNA, 23 nt, artificial
  Completely synthesized
aaaugacaagcugguugagacua

SEQ ID NO: 4752 - RNA, 23 nt, artificial
  Completely synthesized
aaaaugacaagcugguugagacu

SEQ ID NO: 4753 - RNA, 23 nt, artificial
  Completely synthesized
caacaggacauugagcaaguuug

SEQ ID NO: 4754 - RNA, 23 nt, artificial
  Completely synthesized
ucacaucgagagcccagucuuca

SEQ ID NO: 4755 - RNA, 23 nt, artificial
  Completely synthesized
gucacaucgagagcccagucuuc

SEQ ID NO: 4756 - RNA, 23 nt, artificial
  Completely synthesized
ggucacaucgagagcccagucuu

SEQ ID NO: 4757 - RNA, 23 nt, artificial
  Completely synthesized
gaugcuuuguacuuugaugacug

SEQ ID NO: 4758 - RNA, 23 nt, artificial
  Completely synthesized
aaaauuuuaagagcugguacuaa

SEQ ID NO: 4759 - RNA, 23 nt, artificial
  Completely synthesized
ugcuuucagggugguuuugguug

SEQ ID NO: 4760 - RNA, 23 nt, artificial
  Completely synthesized
gcuuucagggugguuuugguuga

SEQ ID NO: 4761 - RNA, 23 nt, artificial
  Completely synthesized
cuuucagggugguuuugguugaa

SEQ ID NO: 4762 - RNA, 23 nt, artificial
  Completely synthesized
uuucagggugguuuugguugaaa

SEQ ID NO: 4763 - RNA, 23 nt, artificial
  Completely synthesized
uucagggugguuuugguugaaag

SEQ ID NO: 4764 - RNA, 23 nt, artificial
  Completely synthesized
guguuuuaggaccauucuguuug

SEQ ID NO: 4765 - RNA, 23 nt, artificial
  Completely synthesized
uguuuuaggaccauucuguuuga

SEQ ID NO: 4766 - RNA, 23 nt, artificial
  Completely synthesized
guuuuaggaccauucuguuugac

SEQ ID NO: 4767 - RNA, 23 nt, artificial
  Completely synthesized
uuuuaggaccauucuguuugaca

SEQ ID NO: 4768 - RNA, 23 nt, artificial
  Completely synthesized
uuuaggaccauucuguuugacac

SEQ ID NO: 4769 - RNA, 23 nt, artificial
  Completely synthesized
gcucuuccacuucagaaucacug

SEQ ID NO: 4770 - RNA, 23 nt, artificial
  Completely synthesized
cucuuccacuucagaaucacuga

SEQ ID NO: 4771 - RNA, 23 nt, artificial
  Completely synthesized
ucuuccacuucagaaucacugag

SEQ ID NO: 4772 - RNA, 23 nt, artificial
  Completely synthesized
cuuccacuucagaaucacugagg

SEQ ID NO: 4773 - RNA, 23 nt, artificial
  Completely synthesized
uuccacuucagaaucacugaggc

SEQ ID NO: 4774 - RNA, 23 nt, artificial
  Completely synthesized
auuuuccaguuuucuuuuucugc

SEQ ID NO: 4775 - RNA, 23 nt, artificial
  Completely synthesized
uuuuccaguuuucuuuuucugca

SEQ ID NO: 4776 - RNA, 23 nt, artificial
  Completely synthesized
uuuccaguuuucuuuuucugcaa

SEQ ID NO: 4777 - RNA, 23 nt, artificial
  Completely synthesized
uuccaguuuucuuuuucugcaau

SEQ ID NO: 4778 - RNA, 23 nt, artificial
  Completely synthesized
uccaguuuucuuuuucugcaauu

SEQ ID NO: 4779 - RNA, 23 nt, artificial
  Completely synthesized
aggcuuucucuugcuccuuuugg

SEQ ID NO: 4780 - RNA, 23 nt, artificial
  Completely synthesized
ggcuuucucuugcuccuuuugga

SEQ ID NO: 4781 - RNA, 23 nt, artificial
  Completely synthesized
gcuuucucuugcuccuuuuggag

SEQ ID NO: 4782 - RNA, 23 nt, artificial
  Completely synthesized
cuuucucuugcuccuuuuggagu

SEQ ID NO: 4783 - RNA, 23 nt, artificial
  Completely synthesized
uuucucuugcuccuuuuggaguu

SEQ ID NO: 4784 - RNA, 23 nt, artificial
  Completely synthesized
uauuuuccaguuuucuuuuucug

SEQ ID NO: 4785 - RNA, 23 nt, artificial
  Completely synthesized
aaaauucaucaccaaaaucugug

SEQ ID NO: 4786 - RNA, 23 nt, artificial
  Completely synthesized
aaauucaucaccaaaaucugugu

SEQ ID NO: 4787 - RNA, 23 nt, artificial
  Completely synthesized
aauucaucaccaaaaucuguguu

SEQ ID NO: 4788 - RNA, 23 nt, artificial
  Completely synthesized
auucaucaccaaaaucuguguug

SEQ ID NO: 4789 - RNA, 23 nt, artificial
  Completely synthesized
uucaucaccaaaaucuguguuga

SEQ ID NO: 4790 - RNA, 23 nt, artificial
  Completely synthesized
uacauagugguuaguuuugcaau

SEQ ID NO: 4791 - RNA, 23 nt, artificial
  Completely synthesized
acauagugguuaguuuugcaaua

SEQ ID NO: 4792 - RNA, 23 nt, artificial
  Completely synthesized
cauagugguuaguuuugcaauaa

SEQ ID NO: 4793 - RNA, 23 nt, artificial
  Completely synthesized
auagugguuaguuuugcaauaau

SEQ ID NO: 4794 - RNA, 23 nt, artificial
  Completely synthesized
uagugguuaguuuugcaauaauu

SEQ ID NO: 4795 - RNA, 23 nt, artificial
  Completely synthesized
uuucuuuuucugcaauucugagc

SEQ ID NO: 4796 - RNA, 23 nt, artificial
  Completely synthesized
uucuuuuucugcaauucugagca

SEQ ID NO: 4797 - RNA, 23 nt, artificial
  Completely synthesized
ucuuuuucugcaauucugagcag

SEQ ID NO: 4798 - RNA, 23 nt, artificial
  Completely synthesized
cuuuuucugcaauucugagcagc

SEQ ID NO: 4799 - RNA, 23 nt, artificial
  Completely synthesized
uuuuucugcaauucugagcagcc

SEQ ID NO: 4800 - RNA, 23 nt, artificial
  Completely synthesized
accauucuguuugacacuuccag

SEQ ID NO: 4801 - RNA, 23 nt, artificial
  Completely synthesized
ccauucuguuugacacuuccagg

SEQ ID NO: 4802 - RNA, 23 nt, artificial
  Completely synthesized
cauucuguuugacacuuccaggg

SEQ ID NO: 4803 - RNA, 23 nt, artificial
  Completely synthesized
auucuguuugacacuuccagggg

SEQ ID NO: 4804 - RNA, 23 nt, artificial
  Completely synthesized
uucuguuugacacuuccaggggc

SEQ ID NO: 4805 - RNA, 23 nt, artificial
  Completely synthesized
auaauuucuuuuuagccagaugu

SEQ ID NO: 4806 - RNA, 23 nt, artificial
  Completely synthesized
uaauuucuuuuuagccagauguc

SEQ ID NO: 4807 - RNA, 23 nt, artificial
  Completely synthesized
aauuucuuuuuagccagauguca

SEQ ID NO: 4808 - RNA, 23 nt, artificial
  Completely synthesized
auuucuuuuuagccagaugucau

SEQ ID NO: 4809 - RNA, 23 nt, artificial
  Completely synthesized
uuucuuuuuagccagaugucaua

SEQ ID NO: 4810 - RNA, 23 nt, artificial
  Completely synthesized
caaguuuuuucuguuuuuccagc

SEQ ID NO: 4811 - RNA, 23 nt, artificial
  Completely synthesized
aaguuuuuucuguuuuuccagcu

SEQ ID NO: 4812 - RNA, 23 nt, artificial
  Completely synthesized
aguuuuuucuguuuuuccagcuc

SEQ ID NO: 4813 - RNA, 23 nt, artificial
  Completely synthesized
guuuuuucuguuuuuccagcuca

SEQ ID NO: 4814 - RNA, 23 nt, artificial
  Completely synthesized
uuuuuucuguuuuuccagcucau

SEQ ID NO: 4815 - RNA, 23 nt, artificial
  Completely synthesized
cugauuaguagcaaugaagacug

SEQ ID NO: 4816 - RNA, 23 nt, artificial
  Completely synthesized
ugauuaguagcaaugaagacugg

SEQ ID NO: 4817 - RNA, 23 nt, artificial
  Completely synthesized
gauuaguagcaaugaagacuggg

SEQ ID NO: 4818 - RNA, 23 nt, artificial
  Completely synthesized
auuaguagcaaugaagacugggc

SEQ ID NO: 4819 - RNA, 23 nt, artificial
  Completely synthesized
uuaguagcaaugaagacugggcu

SEQ ID NO: 4820 - RNA, 23 nt, artificial
  Completely synthesized
aguuuuucuuaacaucuggcuuc

SEQ ID NO: 4821 - RNA, 23 nt, artificial
  Completely synthesized
guuuuucuuaacaucuggcuucu

SEQ ID NO: 4822 - RNA, 23 nt, artificial
  Completely synthesized
uuuuucuuaacaucuggcuucuu

SEQ ID NO: 4823 - RNA, 23 nt, artificial
  Completely synthesized
uuuucuuaacaucuggcuucuua

SEQ ID NO: 4824 - RNA, 23 nt, artificial
  Completely synthesized
uuucuuaacaucuggcuucuuac

SEQ ID NO: 4825 - RNA, 23 nt, artificial
  Completely synthesized
gaaauucaccugucucuucaucu

SEQ ID NO: 4826 - RNA, 23 nt, artificial
  Completely synthesized
aaauucaccugucucuucaucua

SEQ ID NO: 4827 - RNA, 23 nt, artificial
  Completely synthesized
aauucaccugucucuucaucuag

SEQ ID NO: 4828 - RNA, 23 nt, artificial
  Completely synthesized
auucaccugucucuucaucuagu

SEQ ID NO: 4829 - RNA, 23 nt, artificial
  Completely synthesized
uucaccugucucuucaucuaguu

SEQ ID NO: 4830 - RNA, 23 nt, artificial
  Completely synthesized
uuuuucuguuuuuccagcucaua

SEQ ID NO: 4831 - RNA, 23 nt, artificial
  Completely synthesized
ugaauucugcugugcuuucaggg

SEQ ID NO: 4832 - RNA, 23 nt, artificial
  Completely synthesized
gaauucugcugugcuuucagggu

SEQ ID NO: 4833 - RNA, 23 nt, artificial
  Completely synthesized
aauucugcugugcuuucagggug

SEQ ID NO: 4834 - RNA, 23 nt, artificial
  Completely synthesized
auucugcugugcuuucagggugg

SEQ ID NO: 4835 - RNA, 23 nt, artificial
  Completely synthesized
uucugcugugcuuucaggguggu

SEQ ID NO: 4836 - RNA, 23 nt, artificial
  Completely synthesized
cugauucaacauacugacacucc

SEQ ID NO: 4837 - RNA, 23 nt, artificial
  Completely synthesized
ugauucaacauacugacacucca

SEQ ID NO: 4838 - RNA, 23 nt, artificial
  Completely synthesized
gauucaacauacugacacuccaa

SEQ ID NO: 4839 - RNA, 23 nt, artificial
  Completely synthesized
auucaacauacugacacuccaau

SEQ ID NO: 4840 - RNA, 23 nt, artificial
  Completely synthesized
uucaacauacugacacuccaaug

SEQ ID NO: 4841 - RNA, 23 nt, artificial
  Completely synthesized
aguuuucuuuuucugcaauucug

SEQ ID NO: 4842 - RNA, 23 nt, artificial
  Completely synthesized
guuuucuuuuucugcaauucuga

SEQ ID NO: 4843 - RNA, 23 nt, artificial
  Completely synthesized
uuuucuuuuucugcaauucugag

SEQ ID NO: 4844 - RNA, 23 nt, artificial
  Completely synthesized
gagcagccacuuuauucuuaccc

SEQ ID NO: 4845 - RNA, 23 nt, artificial
  Completely synthesized
agcagccacuuuauucuuacccc

SEQ ID NO: 4846 - RNA, 23 nt, artificial
  Completely synthesized
gcagccacuuuauucuuaccccu

SEQ ID NO: 4847 - RNA, 23 nt, artificial
  Completely synthesized
cagccacuuuauucuuaccccuc

SEQ ID NO: 4848 - RNA, 23 nt, artificial
  Completely synthesized
agccacuuuauucuuaccccucc

SEQ ID NO: 4849 - RNA, 23 nt, artificial
  Completely synthesized
uucuuaacaucuggcuucuuacu

SEQ ID NO: 4850 - RNA, 23 nt, artificial
  Completely synthesized
ucuuaacaucuggcuucuuacuu

SEQ ID NO: 4851 - RNA, 23 nt, artificial
  Completely synthesized
cuuaacaucuggcuucuuacuuu

SEQ ID NO: 4852 - RNA, 23 nt, artificial
  Completely synthesized
uuaacaucuggcuucuuacuuuu

SEQ ID NO: 4853 - RNA, 23 nt, artificial
  Completely synthesized
guucuugucuuuccuuuucaagu

SEQ ID NO: 4854 - RNA, 23 nt, artificial
  Completely synthesized
uucuugucuuuccuuuucaaguu

SEQ ID NO: 4855 - RNA, 23 nt, artificial
  Completely synthesized
ucuugucuuuccuuuucaaguuu

SEQ ID NO: 4856 - RNA, 23 nt, artificial
  Completely synthesized
cuugucuuuccuuuucaaguuuu

SEQ ID NO: 4857 - RNA, 23 nt, artificial
  Completely synthesized
uugucuuuccuuuucaaguuuuu

SEQ ID NO: 4858 - RNA, 23 nt, artificial
  Completely synthesized
caaguugagcuucauugaacugc

SEQ ID NO: 4859 - RNA, 23 nt, artificial
  Completely synthesized
aaguugagcuucauugaacugcu

SEQ ID NO: 4860 - RNA, 23 nt, artificial
  Completely synthesized
aguugagcuucauugaacugcuc

SEQ ID NO: 4861 - RNA, 23 nt, artificial
  Completely synthesized
guugagcuucauugaacugcucu

SEQ ID NO: 4862 - RNA, 23 nt, artificial
  Completely synthesized
uugagcuucauugaacugcucuu

SEQ ID NO: 4863 - RNA, 23 nt, artificial
  Completely synthesized
gagcuuuugcccuaaguucaucu

SEQ ID NO: 4864 - RNA, 23 nt, artificial
  Completely synthesized
agcuuuugcccuaaguucaucuc

SEQ ID NO: 4865 - RNA, 23 nt, artificial
  Completely synthesized
gcuuuugcccuaaguucaucucu

SEQ ID NO: 4866 - RNA, 23 nt, artificial
  Completely synthesized
cuuuugcccuaaguucaucucuu

SEQ ID NO: 4867 - RNA, 23 nt, artificial
  Completely synthesized
uuuugcccuaaguucaucucuug

SEQ ID NO: 4868 - RNA, 23 nt, artificial
  Completely synthesized
guuuuuccagcucauacucuuuc

SEQ ID NO: 4869 - RNA, 23 nt, artificial
  Completely synthesized
uuuuuccagcucauacucuuucc

SEQ ID NO: 4870 - RNA, 23 nt, artificial
  Completely synthesized
uuuuccagcucauacucuuuccg

SEQ ID NO: 4871 - RNA, 23 nt, artificial
  Completely synthesized
uuuccagcucauacucuuuccgu

SEQ ID NO: 4872 - RNA, 23 nt, artificial
  Completely synthesized
uuccagcucauacucuuuccguc

SEQ ID NO: 4873 - RNA, 23 nt, artificial
  Completely synthesized
gugauagaucagaaacaucaaug

SEQ ID NO: 4874 - RNA, 23 nt, artificial
  Completely synthesized
ugauagaucagaaacaucaaugg

SEQ ID NO: 4875 - RNA, 23 nt, artificial
  Completely synthesized
gauagaucagaaacaucaauggg

SEQ ID NO: 4876 - RNA, 23 nt, artificial
  Completely synthesized
auagaucagaaacaucaaugggc

SEQ ID NO: 4877 - RNA, 23 nt, artificial
  Completely synthesized
uagaucagaaacaucaaugggcc

SEQ ID NO: 4878 - RNA, 23 nt, artificial
  Completely synthesized
aaacuugcucaauguccuguugc

SEQ ID NO: 4879 - RNA, 23 nt, artificial
  Completely synthesized
aacuugcucaauguccuguugca

SEQ ID NO: 4880 - RNA, 23 nt, artificial
  Completely synthesized
acuugcucaauguccuguugcau

SEQ ID NO: 4881 - RNA, 23 nt, artificial
  Completely synthesized
cuugcucaauguccuguugcaua

SEQ ID NO: 4882 - RNA, 23 nt, artificial
  Completely synthesized
uugcucaauguccuguugcauac

SEQ ID NO: 4883 - RNA, 23 nt, artificial
  Completely synthesized
aaaguacauagugguuaguuuug

SEQ ID NO: 4884 - RNA, 23 nt, artificial
  Completely synthesized
aaguacauagugguuaguuuugc

SEQ ID NO: 4885 - RNA, 23 nt, artificial
  Completely synthesized
aguacauagugguuaguuuugca

SEQ ID NO: 4886 - RNA, 23 nt, artificial
  Completely synthesized
guacauagugguuaguuuugcaa

SEQ ID NO: 4887 - RNA, 23 nt, artificial
  Completely synthesized
cuuauaaaguaugagcauuucac

SEQ ID NO: 4888 - RNA, 23 nt, artificial
  Completely synthesized
uuauaaaguaugagcauuucaca

SEQ ID NO: 4889 - RNA, 23 nt, artificial
  Completely synthesized
uauaaaguaugagcauuucacau

SEQ ID NO: 4890 - RNA, 23 nt, artificial
  Completely synthesized
auaaaguaugagcauuucacauc

SEQ ID NO: 4891 - RNA, 23 nt, artificial
  Completely synthesized
uaaaguaugagcauuucacauca

SEQ ID NO: 4892 - RNA, 23 nt, artificial
  Completely synthesized
gagcuucauugaacugcucuuug

SEQ ID NO: 4893 - RNA, 23 nt, artificial
  Completely synthesized
agcuucauugaacugcucuuugg

SEQ ID NO: 4894 - RNA, 23 nt, artificial
  Completely synthesized
gcuucauugaacugcucuuugga

SEQ ID NO: 4895 - RNA, 23 nt, artificial
  Completely synthesized
cuucauugaacugcucuuuggac

SEQ ID NO: 4896 - RNA, 23 nt, artificial
  Completely synthesized
uucauugaacugcucuuuggaca

SEQ ID NO: 4897 - RNA, 23 nt, artificial
  Completely synthesized
ggacuuacaggcaauucuuucuc

SEQ ID NO: 4898 - RNA, 23 nt, artificial
  Completely synthesized
gacuuacaggcaauucuuucucu

SEQ ID NO: 4899 - RNA, 23 nt, artificial
  Completely synthesized
acuuacaggcaauucuuucucug

SEQ ID NO: 4900 - RNA, 23 nt, artificial
  Completely synthesized
cuuacaggcaauucuuucucugg

SEQ ID NO: 4901 - RNA, 23 nt, artificial
  Completely synthesized
uuacaggcaauucuuucucuggu

SEQ ID NO: 4902 - RNA, 23 nt, artificial
  Completely synthesized
cacauugggcaucaugcacguga

SEQ ID NO: 4903 - RNA, 23 nt, artificial
  Completely synthesized
acauugggcaucaugcacgugag

SEQ ID NO: 4904 - RNA, 23 nt, artificial
  Completely synthesized
cauugggcaucaugcacgugagu

SEQ ID NO: 4905 - RNA, 23 nt, artificial
  Completely synthesized
auugggcaucaugcacgugagug

SEQ ID NO: 4906 - RNA, 23 nt, artificial
  Completely synthesized
uugggcaucaugcacgugagugc

SEQ ID NO: 4907 - RNA, 23 nt, artificial
  Completely synthesized
gugcuuucagggugguuuugguu

SEQ ID NO: 4908 - RNA, 23 nt, artificial
  Completely synthesized
ucuguuugacacuuccaggggca

SEQ ID NO: 4909 - RNA, 23 nt, artificial
  Completely synthesized
aaugauaauugucaacuucuguc

SEQ ID NO: 4910 - RNA, 23 nt, artificial
  Completely synthesized
augauaauugucaacuucuguca

SEQ ID NO: 4911 - RNA, 23 nt, artificial
  Completely synthesized
ugauaauugucaacuucugucag

SEQ ID NO: 4912 - RNA, 23 nt, artificial
  Completely synthesized
gauaauugucaacuucugucagu

SEQ ID NO: 4913 - RNA, 23 nt, artificial
  Completely synthesized
auaauugucaacuucugucaguu

SEQ ID NO: 4914 - RNA, 23 nt, artificial
  Completely synthesized
ccuguugcauaccgucuaaauca

SEQ ID NO: 4915 - RNA, 23 nt, artificial
  Completely synthesized
cuguugcauaccgucuaaaucaa

SEQ ID NO: 4916 - RNA, 23 nt, artificial
  Completely synthesized
uguugcauaccgucuaaaucaac

SEQ ID NO: 4917 - RNA, 23 nt, artificial
  Completely synthesized
guugcauaccgucuaaaucaaca

SEQ ID NO: 4918 - RNA, 23 nt, artificial
  Completely synthesized
uugcauaccgucuaaaucaacag

SEQ ID NO: 4919 - RNA, 23 nt, artificial
  Completely synthesized
guuuuccaucuucaucacguagc

SEQ ID NO: 4920 - RNA, 23 nt, artificial
  Completely synthesized
uuuuccaucuucaucacguagca

SEQ ID NO: 4921 - RNA, 23 nt, artificial
  Completely synthesized
uuuccaucuucaucacguagcau

SEQ ID NO: 4922 - RNA, 23 nt, artificial
  Completely synthesized
uuccaucuucaucacguagcaug

SEQ ID NO: 4923 - RNA, 23 nt, artificial
  Completely synthesized
uccaucuucaucacguagcaugc

SEQ ID NO: 4924 - RNA, 23 nt, artificial
  Completely synthesized
uggcuuaaaguagcaggugaggg

SEQ ID NO: 4925 - RNA, 23 nt, artificial
  Completely synthesized
ggcuuaaaguagcaggugagggc

SEQ ID NO: 4926 - RNA, 23 nt, artificial
  Completely synthesized
gcuuaaaguagcaggugagggca

SEQ ID NO: 4927 - RNA, 23 nt, artificial
  Completely synthesized
cuuaaaguagcaggugagggcau

SEQ ID NO: 4928 - RNA, 23 nt, artificial
  Completely synthesized
uuaaaguagcaggugagggcaug

SEQ ID NO: 4929 - RNA, 23 nt, artificial
  Completely synthesized
agcaucugauuugggaauguggg

SEQ ID NO: 4930 - RNA, 23 nt, artificial
  Completely synthesized
gcaucugauuugggaaugugggc

SEQ ID NO: 4931 - RNA, 23 nt, artificial
  Completely synthesized
caucugauuugggaaugugggca

SEQ ID NO: 4932 - RNA, 23 nt, artificial
  Completely synthesized
aucugauuugggaaugugggcaa

SEQ ID NO: 4933 - RNA, 23 nt, artificial
  Completely synthesized
ucugauuugggaaugugggcaac

SEQ ID NO: 4934 - RNA, 23 nt, artificial
  Completely synthesized
uauuuucuauacuaguuuuggcu

SEQ ID NO: 4935 - RNA, 23 nt, artificial
  Completely synthesized
auuuucuauacuaguuuuggcua

SEQ ID NO: 4936 - RNA, 23 nt, artificial
  Completely synthesized
uuuucuauacuaguuuuggcuau

SEQ ID NO: 4937 - RNA, 23 nt, artificial
  Completely synthesized
uuucuauacuaguuuuggcuaug

SEQ ID NO: 4938 - RNA, 23 nt, artificial
  Completely synthesized
uucuauacuaguuuuggcuauga

SEQ ID NO: 4939 - RNA, 23 nt, artificial
  Completely synthesized
auccuuuauuaguaccagcucuu

SEQ ID NO: 4940 - RNA, 23 nt, artificial
  Completely synthesized
uccuuuauuaguaccagcucuua

SEQ ID NO: 4941 - RNA, 23 nt, artificial
  Completely synthesized
ccuuuauuaguaccagcucuuaa

SEQ ID NO: 4942 - RNA, 23 nt, artificial
  Completely synthesized
cuuuauuaguaccagcucuuaaa

SEQ ID NO: 4943 - RNA, 23 nt, artificial
  Completely synthesized
agcauuucacaucacaguaggag

SEQ ID NO: 4944 - RNA, 23 nt, artificial
  Completely synthesized
gcauuucacaucacaguaggagc

SEQ ID NO: 4945 - RNA, 23 nt, artificial
  Completely synthesized
cauuucacaucacaguaggagcu

SEQ ID NO: 4946 - RNA, 23 nt, artificial
  Completely synthesized
auuucacaucacaguaggagcuu

SEQ ID NO: 4947 - RNA, 23 nt, artificial
  Completely synthesized
uuucacaucacaguaggagcuuu

SEQ ID NO: 4948 - RNA, 23 nt, artificial
  Completely synthesized
uucacaucacaguaggagcuuuu

SEQ ID NO: 4949 - RNA, 23 nt, artificial
  Completely synthesized
aacaucuggcuucuuacuuuugg

SEQ ID NO: 4950 - RNA, 23 nt, artificial
  Completely synthesized
acaucuggcuucuuacuuuuggg

SEQ ID NO: 4951 - RNA, 23 nt, artificial
  Completely synthesized
caucuggcuucuuacuuuuggga

SEQ ID NO: 4952 - RNA, 23 nt, artificial
  Completely synthesized
aucuggcuucuuacuuuugggaa

SEQ ID NO: 4953 - RNA, 23 nt, artificial
  Completely synthesized
ucuggcuucuuacuuuugggaac

SEQ ID NO: 4954 - RNA, 23 nt, artificial
  Completely synthesized
caucuucaucacguagcaugcug

SEQ ID NO: 4955 - RNA, 23 nt, artificial
  Completely synthesized
aucuucaucacguagcaugcuga

SEQ ID NO: 4956 - RNA, 23 nt, artificial
  Completely synthesized
ucuucaucacguagcaugcugaa

SEQ ID NO: 4957 - RNA, 23 nt, artificial
  Completely synthesized
cuucaucacguagcaugcugaaa

SEQ ID NO: 4958 - RNA, 23 nt, artificial
  Completely synthesized
uucaucacguagcaugcugaaaa

SEQ ID NO: 4959 - RNA, 23 nt, artificial
  Completely synthesized
cauuuucuccuuuuucuuugagc

SEQ ID NO: 4960 - RNA, 23 nt, artificial
  Completely synthesized
auuuucuccuuuuucuuugagca

SEQ ID NO: 4961 - RNA, 23 nt, artificial
  Completely synthesized
uuuucuccuuuuucuuugagcaa

SEQ ID NO: 4962 - RNA, 23 nt, artificial
  Completely synthesized
uuucuccuuuuucuuugagcaau

SEQ ID NO: 4963 - RNA, 23 nt, artificial
  Completely synthesized
uucuccuuuuucuuugagcaauu

SEQ ID NO: 4964 - RNA, 23 nt, artificial
  Completely synthesized
uuauuuucuauacuaguuuuggc

SEQ ID NO: 4965 - RNA, 23 nt, artificial
  Completely synthesized
aagguuuuccaucuucaucacgu

SEQ ID NO: 4966 - RNA, 23 nt, artificial
  Completely synthesized
agguuuuccaucuucaucacgua

SEQ ID NO: 4967 - RNA, 23 nt, artificial
  Completely synthesized
gguuuuccaucuucaucacguag

SEQ ID NO: 4968 - RNA, 23 nt, artificial
  Completely synthesized
ccaucuucaucacguagcaugcu

SEQ ID NO: 4969 - RNA, 23 nt, artificial
  Completely synthesized
gcucuuuggacaucauuucguug

SEQ ID NO: 4970 - RNA, 23 nt, artificial
  Completely synthesized
cucuuuggacaucauuucguuga

SEQ ID NO: 4971 - RNA, 23 nt, artificial
  Completely synthesized
ucuuuggacaucauuucguugaa

SEQ ID NO: 4972 - RNA, 23 nt, artificial
  Completely synthesized
cuuuggacaucauuucguugaag

SEQ ID NO: 4973 - RNA, 23 nt, artificial
  Completely synthesized
uuuggacaucauuucguugaagu

SEQ ID NO: 4974 - RNA, 23 nt, artificial
  Completely synthesized
gugguuuugguugaaagcuuugc

SEQ ID NO: 4975 - RNA, 23 nt, artificial
  Completely synthesized
ugguuuugguugaaagcuuugca

SEQ ID NO: 4976 - RNA, 23 nt, artificial
  Completely synthesized
gguuuugguugaaagcuuugcaa

SEQ ID NO: 4977 - RNA, 23 nt, artificial
  Completely synthesized
guuuugguugaaagcuuugcaaa

SEQ ID NO: 4978 - RNA, 23 nt, artificial
  Completely synthesized
uuuugguugaaagcuuugcaaag

SEQ ID NO: 4979 - RNA, 23 nt, artificial
  Completely synthesized
ucaauauuaagacacuguaacuc

SEQ ID NO: 4980 - RNA, 23 nt, artificial
  Completely synthesized
caauauuaagacacuguaacuca

SEQ ID NO: 4981 - RNA, 23 nt, artificial
  Completely synthesized
aauauuaagacacuguaacucag

SEQ ID NO: 4982 - RNA, 23 nt, artificial
  Completely synthesized
auauuaagacacuguaacucagg

SEQ ID NO: 4983 - RNA, 23 nt, artificial
  Completely synthesized
uauuaagacacuguaacucagga

SEQ ID NO: 4984 - RNA, 23 nt, artificial
  Completely synthesized
acacuuacacagaaacuagccca

SEQ ID NO: 4985 - RNA, 23 nt, artificial
  Completely synthesized
cacuuacacagaaacuagcccaa

SEQ ID NO: 4986 - RNA, 23 nt, artificial
  Completely synthesized
acuuacacagaaacuagcccaaa

SEQ ID NO: 4987 - RNA, 23 nt, artificial
  Completely synthesized
cuuacacagaaacuagcccaaau

SEQ ID NO: 4988 - RNA, 23 nt, artificial
  Completely synthesized
uuacacagaaacuagcccaaaug

SEQ ID NO: 4989 - RNA, 23 nt, artificial
  Completely synthesized
uggcuucuggacuuggaaccaug

SEQ ID NO: 4990 - RNA, 23 nt, artificial
  Completely synthesized
ggcuucuggacuuggaaccaugg

SEQ ID NO: 4991 - RNA, 23 nt, artificial
  Completely synthesized
gcuucuggacuuggaaccauggu

SEQ ID NO: 4992 - RNA, 23 nt, artificial
  Completely synthesized
cuucuggacuuggaaccauggua

SEQ ID NO: 4993 - RNA, 23 nt, artificial
  Completely synthesized
uucuggacuuggaaccaugguag

SEQ ID NO: 4994 - RNA, 23 nt, artificial
  Completely synthesized
gaaguuucaggugacugagccug

SEQ ID NO: 4995 - RNA, 23 nt, artificial
  Completely synthesized
aaguuucaggugacugagccuga

SEQ ID NO: 4996 - RNA, 23 nt, artificial
  Completely synthesized
aguuucaggugacugagccugau

SEQ ID NO: 4997 - RNA, 23 nt, artificial
  Completely synthesized
guuucaggugacugagccugauu

SEQ ID NO: 4998 - RNA, 23 nt, artificial
  Completely synthesized
uuucaggugacugagccugauua

SEQ ID NO: 4999 - RNA, 23 nt, artificial
  Completely synthesized
aaaguaugucaaucaaauccaug

SEQ ID NO: 5000 - RNA, 23 nt, artificial
  Completely synthesized
aaguaugucaaucaaauccaugu

SEQ ID NO: 5001 - RNA, 23 nt, artificial
  Completely synthesized
aguaugucaaucaaauccauguc

SEQ ID NO: 5002 - RNA, 23 nt, artificial
  Completely synthesized
guaugucaaucaaauccaugucc

SEQ ID NO: 5003 - RNA, 23 nt, artificial
  Completely synthesized
uaugucaaucaaauccauguccu

SEQ ID NO: 5004 - RNA, 23 nt, artificial
  Completely synthesized
uuggacaucauuucguugaaguc

SEQ ID NO: 5005 - RNA, 23 nt, artificial
  Completely synthesized
cccauuuagaaguucagagagug

SEQ ID NO: 5006 - RNA, 23 nt, artificial
  Completely synthesized
ccauuuagaaguucagagaguga

SEQ ID NO: 5007 - RNA, 23 nt, artificial
  Completely synthesized
cauuuagaaguucagagagugaa

SEQ ID NO: 5008 - RNA, 23 nt, artificial
  Completely synthesized
auuuagaaguucagagagugaau

SEQ ID NO: 5009 - RNA, 23 nt, artificial
  Completely synthesized
uuuagaaguucagagagugaaug

SEQ ID NO: 5010 - RNA, 23 nt, artificial
  Completely synthesized
caaauacuucucgacuuacucca

SEQ ID NO: 5011 - RNA, 23 nt, artificial
  Completely synthesized
aaauacuucucgacuuacuccaa

SEQ ID NO: 5012 - RNA, 23 nt, artificial
  Completely synthesized
aauacuucucgacuuacuccaag

SEQ ID NO: 5013 - RNA, 23 nt, artificial
  Completely synthesized
auacuucucgacuuacuccaaga

SEQ ID NO: 5014 - RNA, 23 nt, artificial
  Completely synthesized
uacuucucgacuuacuccaagau

SEQ ID NO: 5015 - RNA, 23 nt, artificial
  Completely synthesized
ggaguuguucuugucuuuccuuu

SEQ ID NO: 5016 - RNA, 23 nt, artificial
  Completely synthesized
gaguuguucuugucuuuccuuuu

SEQ ID NO: 5017 - RNA, 23 nt, artificial
  Completely synthesized
aguuguucuugucuuuccuuuuc

SEQ ID NO: 5018 - RNA, 23 nt, artificial
  Completely synthesized
guuguucuugucuuuccuuuuca

SEQ ID NO: 5019 - RNA, 23 nt, artificial
  Completely synthesized
uuguucuugucuuuccuuuucaa

SEQ ID NO: 5020 - RNA, 23 nt, artificial
  Completely synthesized
gaucuaaaucuugcucuaguucu

SEQ ID NO: 5021 - RNA, 23 nt, artificial
  Completely synthesized
aucuaaaucuugcucuaguucua

SEQ ID NO: 5022 - RNA, 23 nt, artificial
  Completely synthesized
ucuaaaucuugcucuaguucuac

SEQ ID NO: 5023 - RNA, 23 nt, artificial
  Completely synthesized
cuaaaucuugcucuaguucuacu

SEQ ID NO: 5024 - RNA, 23 nt, artificial
  Completely synthesized
uaaaucuugcucuaguucuacua

SEQ ID NO: 5025 - RNA, 23 nt, artificial
  Completely synthesized
aucauuucguugaagucaacaac

SEQ ID NO: 5026 - RNA, 23 nt, artificial
  Completely synthesized
ucauuucguugaagucaacaaca

SEQ ID NO: 5027 - RNA, 23 nt, artificial
  Completely synthesized
cauuucguugaagucaacaacag

SEQ ID NO: 5028 - RNA, 23 nt, artificial
  Completely synthesized
auuucguugaagucaacaacagg

SEQ ID NO: 5029 - RNA, 23 nt, artificial
  Completely synthesized
uuucguugaagucaacaacaggg

SEQ ID NO: 5030 - RNA, 23 nt, artificial
  Completely synthesized
cugguguuuuaggaccauucugu

SEQ ID NO: 5031 - RNA, 23 nt, artificial
  Completely synthesized
ugguguuuuaggaccauucuguu

SEQ ID NO: 5032 - RNA, 23 nt, artificial
  Completely synthesized
gguguuuuaggaccauucuguuu

SEQ ID NO: 5033 - RNA, 23 nt, artificial
  Completely synthesized
aucauugaauucugcugugcuuu

SEQ ID NO: 5034 - RNA, 23 nt, artificial
  Completely synthesized
ucauugaauucugcugugcuuuc

SEQ ID NO: 5035 - RNA, 23 nt, artificial
  Completely synthesized
cauugaauucugcugugcuuuca

SEQ ID NO: 5036 - RNA, 23 nt, artificial
  Completely synthesized
auugaauucugcugugcuuucag

SEQ ID NO: 5037 - RNA, 23 nt, artificial
  Completely synthesized
uugaauucugcugugcuuucagg

SEQ ID NO: 5038 - RNA, 23 nt, artificial
  Completely synthesized
aaagugauagaucagaaacauca

SEQ ID NO: 5039 - RNA, 23 nt, artificial
  Completely synthesized
aagugauagaucagaaacaucaa

SEQ ID NO: 5040 - RNA, 23 nt, artificial
  Completely synthesized
agugauagaucagaaacaucaau

SEQ ID NO: 5041 - RNA, 23 nt, artificial
  Completely synthesized
agaucagaaacaucaaugggccc

SEQ ID NO: 5042 - RNA, 23 nt, artificial
  Completely synthesized
gaucagaaacaucaaugggccca

SEQ ID NO: 5043 - RNA, 23 nt, artificial
  Completely synthesized
aucagaaacaucaaugggcccau

SEQ ID NO: 5044 - RNA, 23 nt, artificial
  Completely synthesized
cuaguuuuucuuaacaucuggcu

SEQ ID NO: 5045 - RNA, 23 nt, artificial
  Completely synthesized
uaguuuuucuuaacaucuggcuu

SEQ ID NO: 5046 - RNA, 23 nt, artificial
  Completely synthesized
uccuuuuggaguuguucuugucu

SEQ ID NO: 5047 - RNA, 23 nt, artificial
  Completely synthesized
ccuuuuggaguuguucuugucuu

SEQ ID NO: 5048 - RNA, 23 nt, artificial
  Completely synthesized
cuuuuggaguuguucuugucuuu

SEQ ID NO: 5049 - RNA, 23 nt, artificial
  Completely synthesized
uuuuggaguuguucuugucuuuc

SEQ ID NO: 5050 - RNA, 23 nt, artificial
  Completely synthesized
uuuggaguuguucuugucuuucc

SEQ ID NO: 5051 - RNA, 23 nt, artificial
  Completely synthesized
aguauucacuaggagaauaaggu

SEQ ID NO: 5052 - RNA, 23 nt, artificial
  Completely synthesized
guauucacuaggagaauaagguu

SEQ ID NO: 5053 - RNA, 23 nt, artificial
  Completely synthesized
uauucacuaggagaauaagguuu

SEQ ID NO: 5054 - RNA, 23 nt, artificial
  Completely synthesized
auucacuaggagaauaagguuuu

SEQ ID NO: 5055 - RNA, 23 nt, artificial
  Completely synthesized
uucacuaggagaauaagguuuuc

SEQ ID NO: 5056 - RNA, 23 nt, artificial
  Completely synthesized
ucauugaacugcucuuuggacau

SEQ ID NO: 5057 - RNA, 23 nt, artificial
  Completely synthesized
cauugaacugcucuuuggacauc

SEQ ID NO: 5058 - RNA, 23 nt, artificial
  Completely synthesized
auugaacugcucuuuggacauca

SEQ ID NO: 5059 - RNA, 23 nt, artificial
  Completely synthesized
uugaacugcucuuuggacaucau

SEQ ID NO: 5060 - RNA, 23 nt, artificial
  Completely synthesized
auucuuucucugguguguucuca

SEQ ID NO: 5061 - RNA, 23 nt, artificial
  Completely synthesized
uucuuucucugguguguucucac

SEQ ID NO: 5062 - RNA, 23 nt, artificial
  Completely synthesized
ucuuucucugguguguucucaca

SEQ ID NO: 5063 - RNA, 23 nt, artificial
  Completely synthesized
cuuucucugguguguucucacau

SEQ ID NO: 5064 - RNA, 23 nt, artificial
  Completely synthesized
uuucucugguguguucucacauu

SEQ ID NO: 5065 - RNA, 23 nt, artificial
  Completely synthesized
aggaauggauaauagcuccuccc

SEQ ID NO: 5066 - RNA, 23 nt, artificial
  Completely synthesized
ggaauggauaauagcuccuccca

SEQ ID NO: 5067 - RNA, 23 nt, artificial
  Completely synthesized
gaauggauaauagcuccucccaa

SEQ ID NO: 5068 - RNA, 23 nt, artificial
  Completely synthesized
aauggauaauagcuccucccaaa

SEQ ID NO: 5069 - RNA, 23 nt, artificial
  Completely synthesized
auggauaauagcuccucccaaac

SEQ ID NO: 5070 - RNA, 23 nt, artificial
  Completely synthesized
uccaaaguaugucaaucaaaucc

SEQ ID NO: 5071 - RNA, 23 nt, artificial
  Completely synthesized
ccaaaguaugucaaucaaaucca

SEQ ID NO: 5072 - RNA, 23 nt, artificial
  Completely synthesized
caaaguaugucaaucaaauccau

SEQ ID NO: 5073 - RNA, 23 nt, artificial
  Completely synthesized
aagcaucugauuugggaaugugg

SEQ ID NO: 5074 - RNA, 23 nt, artificial
  Completely synthesized
ugucaaucaaauccauguccugc

SEQ ID NO: 5075 - RNA, 23 nt, artificial
  Completely synthesized
gucaaucaaauccauguccugcu

SEQ ID NO: 5076 - RNA, 23 nt, artificial
  Completely synthesized
ucaaucaaauccauguccugcug

SEQ ID NO: 5077 - RNA, 23 nt, artificial
  Completely synthesized
caaucaaauccauguccugcugg

SEQ ID NO: 5078 - RNA, 23 nt, artificial
  Completely synthesized
aaucaaauccauguccugcuggg

SEQ ID NO: 5079 - RNA, 23 nt, artificial
  Completely synthesized
cugguuucugacuggaugugcug

SEQ ID NO: 5080 - RNA, 23 nt, artificial
  Completely synthesized
ugguuucugacuggaugugcugg

SEQ ID NO: 5081 - RNA, 23 nt, artificial
  Completely synthesized
gguuucugacuggaugugcuggg

SEQ ID NO: 5082 - RNA, 23 nt, artificial
  Completely synthesized
guuucugacuggaugugcugggc

SEQ ID NO: 5083 - RNA, 23 nt, artificial
  Completely synthesized
uuucugacuggaugugcugggcu

SEQ ID NO: 5084 - RNA, 23 nt, artificial
  Completely synthesized
aguauuuacacuuacacagaaac

SEQ ID NO: 5085 - RNA, 23 nt, artificial
  Completely synthesized
guauuuacacuuacacagaaacu

SEQ ID NO: 5086 - RNA, 23 nt, artificial
  Completely synthesized
uauuuacacuuacacagaaacua

SEQ ID NO: 5087 - RNA, 23 nt, artificial
  Completely synthesized
auuuacacuuacacagaaacuag

SEQ ID NO: 5088 - RNA, 23 nt, artificial
  Completely synthesized
uuuacacuuacacagaaacuagc

SEQ ID NO: 5089 - RNA, 23 nt, artificial
  Completely synthesized
cuuguuugcugcagggaguauuc

SEQ ID NO: 5090 - RNA, 23 nt, artificial
  Completely synthesized
uuguuugcugcagggaguauuca

SEQ ID NO: 5091 - RNA, 23 nt, artificial
  Completely synthesized
uguuugcugcagggaguauucac

SEQ ID NO: 5092 - RNA, 23 nt, artificial
  Completely synthesized
guuugcugcagggaguauucacu

SEQ ID NO: 5093 - RNA, 23 nt, artificial
  Completely synthesized
uuugcugcagggaguauucacua

SEQ ID NO: 5094 - RNA, 23 nt, artificial
  Completely synthesized
ucaaauacuucucgacuuacucc

SEQ ID NO: 5095 - RNA, 23 nt, artificial
  Completely synthesized
uuaaugcaaguugagcuucauug

SEQ ID NO: 5096 - RNA, 23 nt, artificial
  Completely synthesized
uaaugcaaguugagcuucauuga

SEQ ID NO: 5097 - RNA, 23 nt, artificial
  Completely synthesized
aaugcaaguugagcuucauugaa

SEQ ID NO: 5098 - RNA, 23 nt, artificial
  Completely synthesized
augcaaguugagcuucauugaac

SEQ ID NO: 5099 - RNA, 23 nt, artificial
  Completely synthesized
ugcaaguugagcuucauugaacu

SEQ ID NO: 5100 - RNA, 23 nt, artificial
  Completely synthesized
cuguuuuuccagcucauacucuu

SEQ ID NO: 5101 - RNA, 23 nt, artificial
  Completely synthesized
uguuuuuccagcucauacucuuu

SEQ ID NO: 5102 - RNA, 23 nt, artificial
  Completely synthesized
aauguuugucuuuugugaauggg

SEQ ID NO: 5103 - RNA, 23 nt, artificial
  Completely synthesized
auguuugucuuuugugaaugggg

SEQ ID NO: 5104 - RNA, 23 nt, artificial
  Completely synthesized
uguuugucuuuugugaauggggu

SEQ ID NO: 5105 - RNA, 23 nt, artificial
  Completely synthesized
guuugucuuuugugaaugggguu

SEQ ID NO: 5106 - RNA, 23 nt, artificial
  Completely synthesized
uuugucuuuugugaaugggguuu

SEQ ID NO: 5107 - RNA, 23 nt, artificial
  Completely synthesized
ggacuuguguuuagugaaaugcc

SEQ ID NO: 5108 - RNA, 23 nt, artificial
  Completely synthesized
gacuuguguuuagugaaaugccg

SEQ ID NO: 5109 - RNA, 23 nt, artificial
  Completely synthesized
acuuguguuuagugaaaugccgg

SEQ ID NO: 5110 - RNA, 23 nt, artificial
  Completely synthesized
cuuguguuuagugaaaugccgga

SEQ ID NO: 5111 - RNA, 23 nt, artificial
  Completely synthesized
uuguguuuagugaaaugccggag

SEQ ID NO: 5112 - RNA, 23 nt, artificial
  Completely synthesized
uaaaguagcaggugagggcaugc

SEQ ID NO: 5113 - RNA, 23 nt, artificial
  Completely synthesized
ugaguucacugucaacugguugg

SEQ ID NO: 5114 - RNA, 23 nt, artificial
  Completely synthesized
gaguucacugucaacugguuggg

SEQ ID NO: 5115 - RNA, 23 nt, artificial
  Completely synthesized
aguucacugucaacugguugggg

SEQ ID NO: 5116 - RNA, 23 nt, artificial
  Completely synthesized
guucacugucaacugguuggggu

SEQ ID NO: 5117 - RNA, 23 nt, artificial
  Completely synthesized
uucacugucaacugguugggguc

SEQ ID NO: 5118 - RNA, 23 nt, artificial
  Completely synthesized
auaauagcuccucccaaacuugc

SEQ ID NO: 5119 - RNA, 23 nt, artificial
  Completely synthesized
uaauagcuccucccaaacuugcu

SEQ ID NO: 5120 - RNA, 23 nt, artificial
  Completely synthesized
aauagcuccucccaaacuugcuc

SEQ ID NO: 5121 - RNA, 23 nt, artificial
  Completely synthesized
auagcuccucccaaacuugcuca

SEQ ID NO: 5122 - RNA, 23 nt, artificial
  Completely synthesized
uagcuccucccaaacuugcucaa

SEQ ID NO: 5123 - RNA, 23 nt, artificial
  Completely synthesized
caccugucucuucaucuaguugu

SEQ ID NO: 5124 - RNA, 23 nt, artificial
  Completely synthesized
accugucucuucaucuaguugua

SEQ ID NO: 5125 - RNA, 23 nt, artificial
  Completely synthesized
ccugucucuucaucuaguuguaa

SEQ ID NO: 5126 - RNA, 23 nt, artificial
  Completely synthesized
cugucucuucaucuaguuguaac

SEQ ID NO: 5127 - RNA, 23 nt, artificial
  Completely synthesized
ugucucuucaucuaguuguaacu

SEQ ID NO: 5128 - RNA, 23 nt, artificial
  Completely synthesized
aguuuuggcuaugauuuugcaua

SEQ ID NO: 5129 - RNA, 23 nt, artificial
  Completely synthesized
guuuuggcuaugauuuugcauag

SEQ ID NO: 5130 - RNA, 23 nt, artificial
  Completely synthesized
uuuuggcuaugauuuugcauaga

SEQ ID NO: 5131 - RNA, 23 nt, artificial
  Completely synthesized
uuuggcuaugauuuugcauagaa

SEQ ID NO: 5132 - RNA, 23 nt, artificial
  Completely synthesized
uuggcuaugauuuugcauagaau

SEQ ID NO: 5133 - RNA, 23 nt, artificial
  Completely synthesized
ggugaaggcuuuugucauuuucu

SEQ ID NO: 5134 - RNA, 23 nt, artificial
  Completely synthesized
gugaaggcuuuugucauuuucuc

SEQ ID NO: 5135 - RNA, 23 nt, artificial
  Completely synthesized
ugaaggcuuuugucauuuucucc

SEQ ID NO: 5136 - RNA, 23 nt, artificial
  Completely synthesized
gaaggcuuuugucauuuucuccu

SEQ ID NO: 5137 - RNA, 23 nt, artificial
  Completely synthesized
aaggcuuuugucauuuucuccuu

SEQ ID NO: 5138 - RNA, 23 nt, artificial
  Completely synthesized
uuuucuguuuuuccagcucauac

SEQ ID NO: 5139 - RNA, 23 nt, artificial
  Completely synthesized
uuucuguuuuuccagcucauacu

SEQ ID NO: 5140 - RNA, 23 nt, artificial
  Completely synthesized
aggaugcugcugaaggaauccuc

SEQ ID NO: 5141 - RNA, 23 nt, artificial
  Completely synthesized
ggaugcugcugaaggaauccuca

SEQ ID NO: 5142 - RNA, 23 nt, artificial
  Completely synthesized
gaugcugcugaaggaauccucaa

SEQ ID NO: 5143 - RNA, 23 nt, artificial
  Completely synthesized
augcugcugaaggaauccucaaa

SEQ ID NO: 5144 - RNA, 23 nt, artificial
  Completely synthesized
ugcugcugaaggaauccucaaaa

SEQ ID NO: 5145 - RNA, 23 nt, artificial
  Completely synthesized
gacuuacuccaagaucuauaucu

SEQ ID NO: 5146 - RNA, 23 nt, artificial
  Completely synthesized
acuuacuccaagaucuauaucuu

SEQ ID NO: 5147 - RNA, 23 nt, artificial
  Completely synthesized
cuuacuccaagaucuauaucuug

SEQ ID NO: 5148 - RNA, 23 nt, artificial
  Completely synthesized
uuacuccaagaucuauaucuugc

SEQ ID NO: 5149 - RNA, 23 nt, artificial
  Completely synthesized
uacuccaagaucuauaucuugcc

SEQ ID NO: 5150 - RNA, 23 nt, artificial
  Completely synthesized
uaguuguaacugagcgaaaaagg

SEQ ID NO: 5151 - RNA, 23 nt, artificial
  Completely synthesized
aguuguaacugagcgaaaaaggc

SEQ ID NO: 5152 - RNA, 23 nt, artificial
  Completely synthesized
guuguaacugagcgaaaaaggcu

SEQ ID NO: 5153 - RNA, 23 nt, artificial
  Completely synthesized
uuguaacugagcgaaaaaggcuu

SEQ ID NO: 5154 - RNA, 23 nt, artificial
  Completely synthesized
uguaacugagcgaaaaaggcuuu

SEQ ID NO: 5155 - RNA, 23 nt, artificial
  Completely synthesized
ucuuuuuagccagaugucauauc

SEQ ID NO: 5156 - RNA, 23 nt, artificial
  Completely synthesized
cuuuuuagccagaugucauauca

SEQ ID NO: 5157 - RNA, 23 nt, artificial
  Completely synthesized
uuuuuagccagaugucauaucau

SEQ ID NO: 5158 - RNA, 23 nt, artificial
  Completely synthesized
uuuuagccagaugucauaucauc

SEQ ID NO: 5159 - RNA, 23 nt, artificial
  Completely synthesized
uuuagccagaugucauaucauca

SEQ ID NO: 5160 - RNA, 23 nt, artificial
  Completely synthesized
cgaaaaaggcuuucucuugcucc

SEQ ID NO: 5161 - RNA, 23 nt, artificial
  Completely synthesized
gaaaaaggcuuucucuugcuccu

SEQ ID NO: 5162 - RNA, 23 nt, artificial
  Completely synthesized
aaaaaggcuuucucuugcuccuu

SEQ ID NO: 5163 - RNA, 23 nt, artificial
  Completely synthesized
aaaaggcuuucucuugcuccuuu

SEQ ID NO: 5164 - RNA, 23 nt, artificial
  Completely synthesized
aaaggcuuucucuugcuccuuuu

SEQ ID NO: 5165 - RNA, 23 nt, artificial
  Completely synthesized
aaacuacugauucaacauacuga

SEQ ID NO: 5166 - RNA, 23 nt, artificial
  Completely synthesized
aacuacugauucaacauacugac

SEQ ID NO: 5167 - RNA, 23 nt, artificial
  Completely synthesized
acuacugauucaacauacugaca

SEQ ID NO: 5168 - RNA, 23 nt, artificial
  Completely synthesized
cuacugauucaacauacugacac

SEQ ID NO: 5169 - RNA, 23 nt, artificial
  Completely synthesized
uacugauucaacauacugacacu

SEQ ID NO: 5170 - RNA, 23 nt, artificial
  Completely synthesized
ucuguuuuuccagcucauacucu

SEQ ID NO: 5171 - RNA, 23 nt, artificial
  Completely synthesized
ugggauauggagagcuuuugccc

SEQ ID NO: 5172 - RNA, 23 nt, artificial
  Completely synthesized
gggauauggagagcuuuugcccu

SEQ ID NO: 5173 - RNA, 23 nt, artificial
  Completely synthesized
ggauauggagagcuuuugcccua

SEQ ID NO: 5174 - RNA, 23 nt, artificial
  Completely synthesized
gauauggagagcuuuugcccuaa

SEQ ID NO: 5175 - RNA, 23 nt, artificial
  Completely synthesized
auauggagagcuuuugcccuaag

SEQ ID NO: 5176 - RNA, 23 nt, artificial
  Completely synthesized
cugcugugcuuucagggugguuu

SEQ ID NO: 5177 - RNA, 23 nt, artificial
  Completely synthesized
ugcugugcuuucagggugguuuu

SEQ ID NO: 5178 - RNA, 23 nt, artificial
  Completely synthesized
gcugugcuuucagggugguuuug

SEQ ID NO: 5179 - RNA, 23 nt, artificial
  Completely synthesized
cugugcuuucagggugguuuugg

SEQ ID NO: 5180 - RNA, 23 nt, artificial
  Completely synthesized
ugugcuuucagggugguuuuggu

SEQ ID NO: 5181 - RNA, 23 nt, artificial
  Completely synthesized
uuugguugaaagcuuugcaaagu

SEQ ID NO: 5182 - RNA, 23 nt, artificial
  Completely synthesized
cugaauuuaaugaguucacuguc

SEQ ID NO: 5183 - RNA, 23 nt, artificial
  Completely synthesized
ugaauuuaaugaguucacuguca

SEQ ID NO: 5184 - RNA, 23 nt, artificial
  Completely synthesized
gaauuuaaugaguucacugucaa

SEQ ID NO: 5185 - RNA, 23 nt, artificial
  Completely synthesized
aauuuaaugaguucacugucaac

SEQ ID NO: 5186 - RNA, 23 nt, artificial
  Completely synthesized
auuuaaugaguucacugucaacu

SEQ ID NO: 5187 - RNA, 23 nt, artificial
  Completely synthesized
uuuaaugaguucacugucaacug

SEQ ID NO: 5188 - RNA, 23 nt, artificial
  Completely synthesized
uuaaugaguucacugucaacugg

SEQ ID NO: 5189 - RNA, 23 nt, artificial
  Completely synthesized
uaaugaguucacugucaacuggu

SEQ ID NO: 5190 - RNA, 23 nt, artificial
  Completely synthesized
aaugaguucacugucaacugguu

SEQ ID NO: 5191 - RNA, 23 nt, artificial
  Completely synthesized
cucauugucaucuacaaacggga

SEQ ID NO: 5192 - RNA, 23 nt, artificial
  Completely synthesized
ucauugucaucuacaaacgggaa

SEQ ID NO: 5193 - RNA, 23 nt, artificial
  Completely synthesized
cauugucaucuacaaacgggaau

SEQ ID NO: 5194 - RNA, 23 nt, artificial
  Completely synthesized
auugucaucuacaaacgggaaug

SEQ ID NO: 5195 - RNA, 23 nt, artificial
  Completely synthesized
uugucaucuacaaacgggaaugu

SEQ ID NO: 5196 - RNA, 23 nt, artificial
  Completely synthesized
gucaucuacaaacgggaaugucu

SEQ ID NO: 5197 - RNA, 23 nt, artificial
  Completely synthesized
ucaucuacaaacgggaaugucug

SEQ ID NO: 5198 - RNA, 23 nt, artificial
  Completely synthesized
caucuacaaacgggaaugucugc

SEQ ID NO: 5199 - RNA, 23 nt, artificial
  Completely synthesized
aucuacaaacgggaaugucugcg

SEQ ID NO: 5200 - RNA, 23 nt, artificial
  Completely synthesized
ucuacaaacgggaaugucugcgc

SEQ ID NO: 5201 - RNA, 23 nt, artificial
  Completely synthesized
aguaugagcauuucacaucacag

SEQ ID NO: 5202 - RNA, 23 nt, artificial
  Completely synthesized
guaugagcauuucacaucacagu

SEQ ID NO: 5203 - RNA, 23 nt, artificial
  Completely synthesized
uaugagcauuucacaucacagua

SEQ ID NO: 5204 - RNA, 23 nt, artificial
  Completely synthesized
augagcauuucacaucacaguag

SEQ ID NO: 5205 - RNA, 23 nt, artificial
  Completely synthesized
ugagcauuucacaucacaguagg

SEQ ID NO: 5206 - RNA, 23 nt, artificial
  Completely synthesized
uguucuugucuuuccuuuucaag

SEQ ID NO: 5207 - RNA, 23 nt, artificial
  Completely synthesized
uuugcccuaaguucaucucuugu

SEQ ID NO: 5208 - RNA, 23 nt, artificial
  Completely synthesized
caucucuugugagaugagccucc

SEQ ID NO: 5209 - RNA, 23 nt, artificial
  Completely synthesized
aucucuugugagaugagccucca

SEQ ID NO: 5210 - RNA, 23 nt, artificial
  Completely synthesized
ucucuugugagaugagccuccaa

SEQ ID NO: 5211 - RNA, 23 nt, artificial
  Completely synthesized
cucuugugagaugagccuccaag

SEQ ID NO: 5212 - RNA, 23 nt, artificial
  Completely synthesized
ucuugugagaugagccuccaagc

SEQ ID NO: 5213 - RNA, 23 nt, artificial
  Completely synthesized
ggguuuuccgaugaccaggacuu

SEQ ID NO: 5214 - RNA, 23 nt, artificial
  Completely synthesized
gguuuuccgaugaccaggacuua

SEQ ID NO: 5215 - RNA, 23 nt, artificial
  Completely synthesized
guuuuccgaugaccaggacuuac

SEQ ID NO: 5216 - RNA, 23 nt, artificial
  Completely synthesized
uuuuccgaugaccaggacuuaca

SEQ ID NO: 5217 - RNA, 23 nt, artificial
  Completely synthesized
uuuccgaugaccaggacuuacag

SEQ ID NO: 5218 - RNA, 23 nt, artificial
  Completely synthesized
aagauuccacugaguguucuggu

SEQ ID NO: 5219 - RNA, 23 nt, artificial
  Completely synthesized
agauuccacugaguguucuggug

SEQ ID NO: 5220 - RNA, 23 nt, artificial
  Completely synthesized
gauuccacugaguguucugguga

SEQ ID NO: 5221 - RNA, 23 nt, artificial
  Completely synthesized
auuccacugaguguucuggugau

SEQ ID NO: 5222 - RNA, 23 nt, artificial
  Completely synthesized
uuccacugaguguucuggugaug

SEQ ID NO: 5223 - RNA, 23 nt, artificial
  Completely synthesized
aagcuuugcaaagugauagauca

SEQ ID NO: 5224 - RNA, 23 nt, artificial
  Completely synthesized
agcuuugcaaagugauagaucag

SEQ ID NO: 5225 - RNA, 23 nt, artificial
  Completely synthesized
gcuuugcaaagugauagaucaga

SEQ ID NO: 5226 - RNA, 23 nt, artificial
  Completely synthesized
cuuugcaaagugauagaucagaa

SEQ ID NO: 5227 - RNA, 23 nt, artificial
  Completely synthesized
uuugcaaagugauagaucagaaa

SEQ ID NO: 5228 - RNA, 23 nt, artificial
  Completely synthesized
gggcaugcuguugcugauacugg

SEQ ID NO: 5229 - RNA, 23 nt, artificial
  Completely synthesized
ggcaugcuguugcugauacuggg

SEQ ID NO: 5230 - RNA, 23 nt, artificial
  Completely synthesized
gcaugcuguugcugauacugggc

SEQ ID NO: 5231 - RNA, 23 nt, artificial
  Completely synthesized
caugcuguugcugauacugggcu

SEQ ID NO: 5232 - RNA, 23 nt, artificial
  Completely synthesized
augcuguugcugauacugggcuc

SEQ ID NO: 5233 - RNA, 23 nt, artificial
  Completely synthesized
ccugauuaguagcaaugaagacu

SEQ ID NO: 5234 - RNA, 23 nt, artificial
  Completely synthesized
auaauccuuuauuaguaccagcu

SEQ ID NO: 5235 - RNA, 23 nt, artificial
  Completely synthesized
uaauccuuuauuaguaccagcuc

SEQ ID NO: 5236 - RNA, 23 nt, artificial
  Completely synthesized
aauccuuuauuaguaccagcucu

SEQ ID NO: 5237 - RNA, 23 nt, artificial
  Completely synthesized
acugauucaacauacugacacuc

SEQ ID NO: 5238 - RNA, 23 nt, artificial
  Completely synthesized
ugcaauucugagcagccacuuua

SEQ ID NO: 5239 - RNA, 23 nt, artificial
  Completely synthesized
gcaauucugagcagccacuuuau

SEQ ID NO: 5240 - RNA, 23 nt, artificial
  Completely synthesized
caauucugagcagccacuuuauu

SEQ ID NO: 5241 - RNA, 23 nt, artificial
  Completely synthesized
aauucugagcagccacuuuauuc

SEQ ID NO: 5242 - RNA, 23 nt, artificial
  Completely synthesized
auucugagcagccacuuuauucu

SEQ ID NO: 5243 - RNA, 23 nt, artificial
  Completely synthesized
ugauuuuuucuacagggaauggg

SEQ ID NO: 5244 - RNA, 23 nt, artificial
  Completely synthesized
gauuuuuucuacagggaauggga

SEQ ID NO: 5245 - RNA, 23 nt, artificial
  Completely synthesized
auuuuuucuacagggaaugggau

SEQ ID NO: 5246 - RNA, 23 nt, artificial
  Completely synthesized
uuuuuucuacagggaaugggaua

SEQ ID NO: 5247 - RNA, 23 nt, artificial
  Completely synthesized
uuuuucuacagggaaugggauau

SEQ ID NO: 5248 - RNA, 23 nt, artificial
  Completely synthesized
caauucuuucucugguguguucu

SEQ ID NO: 5249 - RNA, 23 nt, artificial
  Completely synthesized
aauucuuucucugguguguucuc

SEQ ID NO: 5250 - RNA, 23 nt, artificial
  Completely synthesized
ucucacauugggcaucaugcacg

SEQ ID NO: 5251 - RNA, 23 nt, artificial
  Completely synthesized
cucacauugggcaucaugcacgu

SEQ ID NO: 5252 - RNA, 23 nt, artificial
  Completely synthesized
ucacauugggcaucaugcacgug

SEQ ID NO: 5253 - RNA, 23 nt, artificial
  Completely synthesized
gaagauuccacugaguguucugg

SEQ ID NO: 5254 - RNA, 23 nt, artificial
  Completely synthesized
aguguucuggugaugccacacug

SEQ ID NO: 5255 - RNA, 23 nt, artificial
  Completely synthesized
guguucuggugaugccacacugg

SEQ ID NO: 5256 - RNA, 23 nt, artificial
  Completely synthesized
uguucuggugaugccacacuggg

SEQ ID NO: 5257 - RNA, 23 nt, artificial
  Completely synthesized
guucuggugaugccacacuggga

SEQ ID NO: 5258 - RNA, 23 nt, artificial
  Completely synthesized
uucuggugaugccacacugggac

SEQ ID NO: 5259 - RNA, 23 nt, artificial
  Completely synthesized
auugucaacuucugucaguuugg

SEQ ID NO: 5260 - RNA, 23 nt, artificial
  Completely synthesized
uugucaacuucugucaguuuggc

SEQ ID NO: 5261 - RNA, 23 nt, artificial
  Completely synthesized
ugucaacuucugucaguuuggcu

SEQ ID NO: 5262 - RNA, 23 nt, artificial
  Completely synthesized
gucaacuucugucaguuuggcuu

SEQ ID NO: 5263 - RNA, 23 nt, artificial
  Completely synthesized
ucaacuucugucaguuuggcuuc

SEQ ID NO: 5264 - RNA, 23 nt, artificial
  Completely synthesized
ucaauguccuguugcauaccguc

SEQ ID NO: 5265 - RNA, 23 nt, artificial
  Completely synthesized
caauguccuguugcauaccgucu

SEQ ID NO: 5266 - RNA, 23 nt, artificial
  Completely synthesized
aauguccuguugcauaccgucua

SEQ ID NO: 5267 - RNA, 23 nt, artificial
  Completely synthesized
auguccuguugcauaccgucuaa

SEQ ID NO: 5268 - RNA, 23 nt, artificial
  Completely synthesized
uguccuguugcauaccgucuaaa

SEQ ID NO: 5269 - RNA, 23 nt, artificial
  Completely synthesized
gcagauccacugguuucugacug

SEQ ID NO: 5270 - RNA, 23 nt, artificial
  Completely synthesized
cagauccacugguuucugacugg

SEQ ID NO: 5271 - RNA, 23 nt, artificial
  Completely synthesized
agauccacugguuucugacugga

SEQ ID NO: 5272 - RNA, 23 nt, artificial
  Completely synthesized
gauccacugguuucugacuggau

SEQ ID NO: 5273 - RNA, 23 nt, artificial
  Completely synthesized
auccacugguuucugacuggaug

SEQ ID NO: 5274 - RNA, 23 nt, artificial
  Completely synthesized
aucaaauccauguccugcuggga

SEQ ID NO: 5275 - RNA, 23 nt, artificial
  Completely synthesized
ugaauugggagaaauucaccugu

SEQ ID NO: 5276 - RNA, 23 nt, artificial
  Completely synthesized
gaauugggagaaauucaccuguc

SEQ ID NO: 5277 - RNA, 23 nt, artificial
  Completely synthesized
aauugggagaaauucaccugucu

SEQ ID NO: 5278 - RNA, 23 nt, artificial
  Completely synthesized
auugggagaaauucaccugucuc

SEQ ID NO: 5279 - RNA, 23 nt, artificial
  Completely synthesized
uugggagaaauucaccugucucu

SEQ ID NO: 5280 - RNA, 23 nt, artificial
  Completely synthesized
aggcuuuugucauuuucuccuuu

SEQ ID NO: 5281 - RNA, 23 nt, artificial
  Completely synthesized
ggcuuuugucauuuucuccuuuu

SEQ ID NO: 5282 - RNA, 23 nt, artificial
  Completely synthesized
gcuuuugucauuuucuccuuuuu

SEQ ID NO: 5283 - RNA, 23 nt, artificial
  Completely synthesized
cuuuugucauuuucuccuuuuuc

SEQ ID NO: 5284 - RNA, 23 nt, artificial
  Completely synthesized
uuuugucauuuucuccuuuuucu

SEQ ID NO: 5285 - RNA, 23 nt, artificial
  Completely synthesized
uuugucauuuucuccuuuuucuu

SEQ ID NO: 5286 - RNA, 23 nt, artificial
  Completely synthesized
uugucauuuucuccuuuuucuuu

SEQ ID NO: 5287 - RNA, 23 nt, artificial
  Completely synthesized
ugucauuuucuccuuuuucuuug

SEQ ID NO: 5288 - RNA, 23 nt, artificial
  Completely synthesized
cugcucuuuggacaucauuucgu

SEQ ID NO: 5289 - RNA, 23 nt, artificial
  Completely synthesized
ugcucuuuggacaucauuucguu

SEQ ID NO: 5290 - RNA, 23 nt, artificial
  Completely synthesized
uucguugaagucaacaacaggga

SEQ ID NO: 5291 - RNA, 23 nt, artificial
  Completely synthesized
uugcccuaaguucaucucuugug

SEQ ID NO: 5292 - RNA, 23 nt, artificial
  Completely synthesized
gucaaauacuucucgacuuacuc

SEQ ID NO: 5293 - RNA, 23 nt, artificial
  Completely synthesized
uucuuuuuagccagaugucauau

SEQ ID NO: 5294 - RNA, 23 nt, artificial
  Completely synthesized
cacguagcaugcugaaaacuucg

SEQ ID NO: 5295 - RNA, 23 nt, artificial
  Completely synthesized
acguagcaugcugaaaacuucga

SEQ ID NO: 5296 - RNA, 23 nt, artificial
  Completely synthesized
cguagcaugcugaaaacuucgag

SEQ ID NO: 5297 - RNA, 23 nt, artificial
  Completely synthesized
guagcaugcugaaaacuucgaga

SEQ ID NO: 5298 - RNA, 23 nt, artificial
  Completely synthesized
uagcaugcugaaaacuucgagau

SEQ ID NO: 5299 - RNA, 23 nt, artificial
  Completely synthesized
gcugaaaacuucgagauauaagg

SEQ ID NO: 5300 - RNA, 23 nt, artificial
  Completely synthesized
cugaaaacuucgagauauaaggu

SEQ ID NO: 5301 - RNA, 23 nt, artificial
  Completely synthesized
ugaaaacuucgagauauaaggug

SEQ ID NO: 5302 - RNA, 23 nt, artificial
  Completely synthesized
gaaaacuucgagauauaaggugc

SEQ ID NO: 5303 - RNA, 23 nt, artificial
  Completely synthesized
aaaacuucgagauauaaggugcu

SEQ ID NO: 5304 - RNA, 23 nt, artificial
  Completely synthesized
ucaaaugaucuaaaucuugcucu

SEQ ID NO: 5305 - RNA, 23 nt, artificial
  Completely synthesized
caaaugaucuaaaucuugcucua

SEQ ID NO: 5306 - RNA, 23 nt, artificial
  Completely synthesized
aaaugaucuaaaucuugcucuag

SEQ ID NO: 5307 - RNA, 23 nt, artificial
  Completely synthesized
aaugaucuaaaucuugcucuagu

SEQ ID NO: 5308 - RNA, 23 nt, artificial
  Completely synthesized
augaucuaaaucuugcucuaguu

SEQ ID NO: 5309 - RNA, 23 nt, artificial
  Completely synthesized
gaacugcucuuuggacaucauuu

SEQ ID NO: 5310 - RNA, 23 nt, artificial
  Completely synthesized
aacugcucuuuggacaucauuuc

SEQ ID NO: 5311 - RNA, 23 nt, artificial
  Completely synthesized
acugcucuuuggacaucauuucg

SEQ ID NO: 5312 - RNA, 23 nt, artificial
  Completely synthesized
uucuguuuuuccagcucauacuc

SEQ ID NO: 5313 - RNA, 23 nt, artificial
  Completely synthesized
ggcuugaauguuugucuuuugug

SEQ ID NO: 5314 - RNA, 23 nt, artificial
  Completely synthesized
gcuugaauguuugucuuuuguga

SEQ ID NO: 5315 - RNA, 23 nt, artificial
  Completely synthesized
cuugaauguuugucuuuugugaa

SEQ ID NO: 5316 - RNA, 23 nt, artificial
  Completely synthesized
uugaauguuugucuuuugugaau

SEQ ID NO: 5317 - RNA, 23 nt, artificial
  Completely synthesized
ugaauguuugucuuuugugaaug

SEQ ID NO: 5318 - RNA, 23 nt, artificial
  Completely synthesized
uucucugguguguucucacauug

SEQ ID NO: 5319 - RNA, 23 nt, artificial
  Completely synthesized
guacugguguuuuaggaccauuc

SEQ ID NO: 5320 - RNA, 23 nt, artificial
  Completely synthesized
uacugguguuuuaggaccauucu

SEQ ID NO: 5321 - RNA, 23 nt, artificial
  Completely synthesized
acugguguuuuaggaccauucug

SEQ ID NO: 5322 - RNA, 23 nt, artificial
  Completely synthesized
ucagaaacaucaaugggcccauu

SEQ ID NO: 5323 - RNA, 23 nt, artificial
  Completely synthesized
ucaguuuggcuucuggacuugga

SEQ ID NO: 5324 - RNA, 23 nt, artificial
  Completely synthesized
caguuuggcuucuggacuuggaa

SEQ ID NO: 5325 - RNA, 23 nt, artificial
  Completely synthesized
aguuuggcuucuggacuuggaac

SEQ ID NO: 5326 - RNA, 23 nt, artificial
  Completely synthesized
guuuggcuucuggacuuggaacc

SEQ ID NO: 5327 - RNA, 23 nt, artificial
  Completely synthesized
uuuggcuucuggacuuggaacca

SEQ ID NO: 5328 - RNA, 23 nt, artificial
  Completely synthesized
uuuucugcaauucugagcagcca

SEQ ID NO: 5329 - RNA, 23 nt, artificial
  Completely synthesized
gguuaaugauuuuuucuacaggg

SEQ ID NO: 5330 - RNA, 23 nt, artificial
  Completely synthesized
guuaaugauuuuuucuacaggga

SEQ ID NO: 5331 - RNA, 23 nt, artificial
  Completely synthesized
uuaaugauuuuuucuacagggaa

SEQ ID NO: 5332 - RNA, 23 nt, artificial
  Completely synthesized
uaaugauuuuuucuacagggaau

SEQ ID NO: 5333 - RNA, 23 nt, artificial
  Completely synthesized
aaugauuuuuucuacagggaaug

SEQ ID NO: 5334 - RNA, 23 nt, artificial
  Completely synthesized
gggguuuuccgaugaccaggacu

SEQ ID NO: 5335 - RNA, 23 nt, artificial
  Completely synthesized
cuucucgacuuacuccaagaucu

SEQ ID NO: 5336 - RNA, 23 nt, artificial
  Completely synthesized
uucucgacuuacuccaagaucua

SEQ ID NO: 5337 - RNA, 23 nt, artificial
  Completely synthesized
ucucgacuuacuccaagaucuau

SEQ ID NO: 5338 - RNA, 23 nt, artificial
  Completely synthesized
cucgacuuacuccaagaucuaua

SEQ ID NO: 5339 - RNA, 23 nt, artificial
  Completely synthesized
ucgacuuacuccaagaucuauau

SEQ ID NO: 5340 - RNA, 23 nt, artificial
  Completely synthesized
augaguucacugucaacugguug

SEQ ID NO: 5341 - RNA, 23 nt, artificial
  Completely synthesized
ggacuacaguuaccuacuucuuu

SEQ ID NO: 5342 - RNA, 23 nt, artificial
  Completely synthesized
gacuacaguuaccuacuucuuuu

SEQ ID NO: 5343 - RNA, 23 nt, artificial
  Completely synthesized
acuacaguuaccuacuucuuuuu

SEQ ID NO: 5344 - RNA, 23 nt, artificial
  Completely synthesized
cuacaguuaccuacuucuuuuuc

SEQ ID NO: 5345 - RNA, 23 nt, artificial
  Completely synthesized
uacaguuaccuacuucuuuuucc

SEQ ID NO: 5346 - RNA, 23 nt, artificial
  Completely synthesized
acuccaagaucuauaucuugccu

SEQ ID NO: 5347 - RNA, 23 nt, artificial
  Completely synthesized
cuccaagaucuauaucuugccuc

SEQ ID NO: 5348 - RNA, 23 nt, artificial
  Completely synthesized
uccaagaucuauaucuugccucc

SEQ ID NO: 5349 - RNA, 23 nt, artificial
  Completely synthesized
ucuggacuuggaaccaugguagu

SEQ ID NO: 5350 - RNA, 23 nt, artificial
  Completely synthesized
uuguuuuuucaguaggugaaggc

SEQ ID NO: 5351 - RNA, 23 nt, artificial
  Completely synthesized
uguuuuuucaguaggugaaggcu

SEQ ID NO: 5352 - RNA, 23 nt, artificial
  Completely synthesized
guuuuuucaguaggugaaggcuu

SEQ ID NO: 5353 - RNA, 23 nt, artificial
  Completely synthesized
uuuuuucaguaggugaaggcuuu

SEQ ID NO: 5354 - RNA, 23 nt, artificial
  Completely synthesized
uuuuucaguaggugaaggcuuuu

SEQ ID NO: 5355 - RNA, 23 nt, artificial
  Completely synthesized
cuugugagaugagccuccaagcg

SEQ ID NO: 5356 - RNA, 23 nt, artificial
  Completely synthesized
uugugagaugagccuccaagcgg

SEQ ID NO: 5357 - RNA, 23 nt, artificial
  Completely synthesized
ugugagaugagccuccaagcggc

SEQ ID NO: 5358 - RNA, 23 nt, artificial
  Completely synthesized
uccagcucauacucuuuccgucg

SEQ ID NO: 5359 - RNA, 23 nt, artificial
  Completely synthesized
uccgaugaccaggacuuacaggc

SEQ ID NO: 5360 - RNA, 23 nt, artificial
  Completely synthesized
ccgaugaccaggacuuacaggca

SEQ ID NO: 5361 - RNA, 23 nt, artificial
  Completely synthesized
cgaugaccaggacuuacaggcaa

SEQ ID NO: 5362 - RNA, 23 nt, artificial
  Completely synthesized
gaugaccaggacuuacaggcaau

SEQ ID NO: 5363 - RNA, 23 nt, artificial
  Completely synthesized
augaccaggacuuacaggcaauu

SEQ ID NO: 5364 - RNA, 23 nt, artificial
  Completely synthesized
uaacucaggaauggauaauagcu

SEQ ID NO: 5365 - RNA, 23 nt, artificial
  Completely synthesized
aacucaggaauggauaauagcuc

SEQ ID NO: 5366 - RNA, 23 nt, artificial
  Completely synthesized
acucaggaauggauaauagcucc

SEQ ID NO: 5367 - RNA, 23 nt, artificial
  Completely synthesized
cucaggaauggauaauagcuccu

SEQ ID NO: 5368 - RNA, 23 nt, artificial
  Completely synthesized
ucaggaauggauaauagcuccuc

SEQ ID NO: 5369 - RNA, 23 nt, artificial
  Completely synthesized
gaucuauaucuugccuccaaagu

SEQ ID NO: 5370 - RNA, 23 nt, artificial
  Completely synthesized
aucuauaucuugccuccaaagua

SEQ ID NO: 5371 - RNA, 23 nt, artificial
  Completely synthesized
ucuauaucuugccuccaaaguau

SEQ ID NO: 5372 - RNA, 23 nt, artificial
  Completely synthesized
cuauaucuugccuccaaaguaug

SEQ ID NO: 5373 - RNA, 23 nt, artificial
  Completely synthesized
uauaucuugccuccaaaguaugu

SEQ ID NO: 5374 - RNA, 23 nt, artificial
  Completely synthesized
augucaaucaaauccauguccug

SEQ ID NO: 5375 - RNA, 23 nt, artificial
  Completely synthesized
cuucaucuaguuguaacugagcg

SEQ ID NO: 5376 - RNA, 23 nt, artificial
  Completely synthesized
uucaucuaguuguaacugagcga

SEQ ID NO: 5377 - RNA, 23 nt, artificial
  Completely synthesized
ucaucuaguuguaacugagcgaa

SEQ ID NO: 5378 - RNA, 23 nt, artificial
  Completely synthesized
caucuaguuguaacugagcgaaa

SEQ ID NO: 5379 - RNA, 23 nt, artificial
  Completely synthesized
aucuaguuguaacugagcgaaaa

SEQ ID NO: 5380 - RNA, 23 nt, artificial
  Completely synthesized
uucugagcagccacuuuauucuu

SEQ ID NO: 5381 - RNA, 23 nt, artificial
  Completely synthesized
ucugagcagccacuuuauucuua

SEQ ID NO: 5382 - RNA, 23 nt, artificial
  Completely synthesized
cugagcagccacuuuauucuuac

SEQ ID NO: 5383 - RNA, 23 nt, artificial
  Completely synthesized
ugagcagccacuuuauucuuacc

SEQ ID NO: 5384 - RNA, 23 nt, artificial
  Completely synthesized
caggacuuacaggcaauucuuuc

SEQ ID NO: 5385 - RNA, 23 nt, artificial
  Completely synthesized
aggacuuacaggcaauucuuucu

SEQ ID NO: 5386 - RNA, 23 nt, artificial
  Completely synthesized
gcaauucuuucucugguguguuc

SEQ ID NO: 5387 - RNA, 23 nt, artificial
  Completely synthesized
agugaauggcuuaaaguagcagg

SEQ ID NO: 5388 - RNA, 23 nt, artificial
  Completely synthesized
gugaauggcuuaaaguagcaggu

SEQ ID NO: 5389 - RNA, 23 nt, artificial
  Completely synthesized
ugaauggcuuaaaguagcaggug

SEQ ID NO: 5390 - RNA, 23 nt, artificial
  Completely synthesized
gaauggcuuaaaguagcagguga

SEQ ID NO: 5391 - RNA, 23 nt, artificial
  Completely synthesized
aauggcuuaaaguagcaggugag

SEQ ID NO: 5392 - RNA, 23 nt, artificial
  Completely synthesized
uuuucuacagggaaugggauaug

SEQ ID NO: 5393 - RNA, 23 nt, artificial
  Completely synthesized
gaauguuugucuuuugugaaugg

SEQ ID NO: 5394 - RNA, 23 nt, artificial
  Completely synthesized
uaauugucaacuucugucaguuu

SEQ ID NO: 5395 - RNA, 23 nt, artificial
  Completely synthesized
uucugacuggaugugcugggcug

SEQ ID NO: 5396 - RNA, 23 nt, artificial
  Completely synthesized
uuacacuuacacagaaacuagcc

SEQ ID NO: 5397 - RNA, 23 nt, artificial
  Completely synthesized
ugaguuguuuuuucaguagguga

SEQ ID NO: 5398 - RNA, 23 nt, artificial
  Completely synthesized
gaguuguuuuuucaguaggugaa

SEQ ID NO: 5399 - RNA, 23 nt, artificial
  Completely synthesized
aguuguuuuuucaguaggugaag

SEQ ID NO: 5400 - RNA, 23 nt, artificial
  Completely synthesized
guuguuuuuucaguaggugaagg

SEQ ID NO: 5401 - RNA, 23 nt, artificial
  Completely synthesized
guucaucucuugugagaugagcc

SEQ ID NO: 5402 - RNA, 23 nt, artificial
  Completely synthesized
uucaucucuugugagaugagccu

SEQ ID NO: 5403 - RNA, 23 nt, artificial
  Completely synthesized
ucaucucuugugagaugagccuc

SEQ ID NO: 5404 - RNA, 23 nt, artificial
  Completely synthesized
cucauacucuuuccgucgcugac

SEQ ID NO: 5405 - RNA, 23 nt, artificial
  Completely synthesized
ucauacucuuuccgucgcugacu

SEQ ID NO: 5406 - RNA, 23 nt, artificial
  Completely synthesized
cauacucuuuccgucgcugacug

SEQ ID NO: 5407 - RNA, 23 nt, artificial
  Completely synthesized
auacucuuuccgucgcugacuga

SEQ ID NO: 5408 - RNA, 23 nt, artificial
  Completely synthesized
uacucuuuccgucgcugacugaa

SEQ ID NO: 5409 - RNA, 23 nt, artificial
  Completely synthesized
acuaucuagcucuuccacuucag

SEQ ID NO: 5410 - RNA, 23 nt, artificial
  Completely synthesized
cuaucuagcucuuccacuucaga

SEQ ID NO: 5411 - RNA, 23 nt, artificial
  Completely synthesized
uaucuagcucuuccacuucagaa

SEQ ID NO: 5412 - RNA, 23 nt, artificial
  Completely synthesized
aucuagcucuuccacuucagaau

SEQ ID NO: 5413 - RNA, 23 nt, artificial
  Completely synthesized
ucuagcucuuccacuucagaauc

SEQ ID NO: 5414 - RNA, 23 nt, artificial
  Completely synthesized
guggacuacaguuaccuacuucu

SEQ ID NO: 5415 - RNA, 23 nt, artificial
  Completely synthesized
uggacuacaguuaccuacuucuu

SEQ ID NO: 5416 - RNA, 23 nt, artificial
  Completely synthesized
ggacuuggaaccaugguagucuc

SEQ ID NO: 5417 - RNA, 23 nt, artificial
  Completely synthesized
gacuuggaaccaugguagucuca

SEQ ID NO: 5418 - RNA, 23 nt, artificial
  Completely synthesized
acuuggaaccaugguagucucaa

SEQ ID NO: 5419 - RNA, 23 nt, artificial
  Completely synthesized
cuuggaaccaugguagucucaac

SEQ ID NO: 5420 - RNA, 23 nt, artificial
  Completely synthesized
uuggaaccaugguagucucaacc

SEQ ID NO: 5421 - RNA, 23 nt, artificial
  Completely synthesized
caggaauggauaauagcuccucc

SEQ ID NO: 5422 - RNA, 23 nt, artificial
  Completely synthesized
uaucuugccuccaaaguauguca

SEQ ID NO: 5423 - RNA, 23 nt, artificial
  Completely synthesized
aucuugccuccaaaguaugucaa

SEQ ID NO: 5424 - RNA, 23 nt, artificial
  Completely synthesized
ucuugccuccaaaguaugucaau

SEQ ID NO: 5425 - RNA, 23 nt, artificial
  Completely synthesized
cuugccuccaaaguaugucaauc

SEQ ID NO: 5426 - RNA, 23 nt, artificial
  Completely synthesized
uugccuccaaaguaugucaauca

SEQ ID NO: 5427 - RNA, 23 nt, artificial
  Completely synthesized
cugaauugggagaaauucaccug

SEQ ID NO: 5428 - RNA, 23 nt, artificial
  Completely synthesized
agugguuaguuuugcaauaauuu

SEQ ID NO: 5429 - RNA, 23 nt, artificial
  Completely synthesized
ucacuaggagaauaagguuuucc

SEQ ID NO: 5430 - RNA, 23 nt, artificial
  Completely synthesized
cacuaggagaauaagguuuucca

SEQ ID NO: 5431 - RNA, 23 nt, artificial
  Completely synthesized
acuaggagaauaagguuuuccau

SEQ ID NO: 5432 - RNA, 23 nt, artificial
  Completely synthesized
cuaggagaauaagguuuuccauc

SEQ ID NO: 5433 - RNA, 23 nt, artificial
  Completely synthesized
uaggagaauaagguuuuccaucu

SEQ ID NO: 5434 - RNA, 23 nt, artificial
  Completely synthesized
gagaauaagguuuuccaucuuca

SEQ ID NO: 5435 - RNA, 23 nt, artificial
  Completely synthesized
agaauaagguuuuccaucuucau

SEQ ID NO: 5436 - RNA, 23 nt, artificial
  Completely synthesized
gaauaagguuuuccaucuucauc

SEQ ID NO: 5437 - RNA, 23 nt, artificial
  Completely synthesized
aauaagguuuuccaucuucauca

SEQ ID NO: 5438 - RNA, 23 nt, artificial
  Completely synthesized
auaagguuuuccaucuucaucac

SEQ ID NO: 5439 - RNA, 23 nt, artificial
  Completely synthesized
gauauaaggugcugaguuguuuu

SEQ ID NO: 5440 - RNA, 23 nt, artificial
  Completely synthesized
auauaaggugcugaguuguuuuu

SEQ ID NO: 5441 - RNA, 23 nt, artificial
  Completely synthesized
uauaaggugcugaguuguuuuuu

SEQ ID NO: 5442 - RNA, 23 nt, artificial
  Completely synthesized
auaaggugcugaguuguuuuuuc

SEQ ID NO: 5443 - RNA, 23 nt, artificial
  Completely synthesized
uaaggugcugaguuguuuuuuca

SEQ ID NO: 5444 - RNA, 23 nt, artificial
  Completely synthesized
aaaucuugcucuaguucuacuau

SEQ ID NO: 5445 - RNA, 23 nt, artificial
  Completely synthesized
aaucuugcucuaguucuacuaua

SEQ ID NO: 5446 - RNA, 23 nt, artificial
  Completely synthesized
aucuugcucuaguucuacuauau

SEQ ID NO: 5447 - RNA, 23 nt, artificial
  Completely synthesized
ucuugcucuaguucuacuauauu

SEQ ID NO: 5448 - RNA, 23 nt, artificial
  Completely synthesized
uuucugcaauucugagcagccac

SEQ ID NO: 5449 - RNA, 23 nt, artificial
  Completely synthesized
uucugcaauucugagcagccacu

SEQ ID NO: 5450 - RNA, 23 nt, artificial
  Completely synthesized
ucugcaauucugagcagccacuu

SEQ ID NO: 5451 - RNA, 23 nt, artificial
  Completely synthesized
acucuuuccgucgcugacugaag

SEQ ID NO: 5452 - RNA, 23 nt, artificial
  Completely synthesized
cucuuuccgucgcugacugaagu

SEQ ID NO: 5453 - RNA, 23 nt, artificial
  Completely synthesized
ucuuuccgucgcugacugaaguc

SEQ ID NO: 5454 - RNA, 23 nt, artificial
  Completely synthesized
cuuuccgucgcugacugaaguca

SEQ ID NO: 5455 - RNA, 23 nt, artificial
  Completely synthesized
uuuccgucgcugacugaagucaa

SEQ ID NO: 5456 - RNA, 23 nt, artificial
  Completely synthesized
ccacuucagaaucacugaggcca

SEQ ID NO: 5457 - RNA, 23 nt, artificial
  Completely synthesized
cacuucagaaucacugaggccaa

SEQ ID NO: 5458 - RNA, 23 nt, artificial
  Completely synthesized
acuucagaaucacugaggccaag

SEQ ID NO: 5459 - RNA, 23 nt, artificial
  Completely synthesized
cuucagaaucacugaggccaagu

SEQ ID NO: 5460 - RNA, 23 nt, artificial
  Completely synthesized
uucagaaucacugaggccaagua

SEQ ID NO: 5461 - RNA, 23 nt, artificial
  Completely synthesized
caaguagugugucuccauagcug

SEQ ID NO: 5462 - RNA, 23 nt, artificial
  Completely synthesized
aaguagugugucuccauagcugg

SEQ ID NO: 5463 - RNA, 23 nt, artificial
  Completely synthesized
aguagugugucuccauagcugga

SEQ ID NO: 5464 - RNA, 23 nt, artificial
  Completely synthesized
guagugugucuccauagcuggaa

SEQ ID NO: 5465 - RNA, 23 nt, artificial
  Completely synthesized
uagugugucuccauagcuggaag

SEQ ID NO: 5466 - RNA, 23 nt, artificial
  Completely synthesized
ucagggugguuuugguugaaagc

SEQ ID NO: 5467 - RNA, 23 nt, artificial
  Completely synthesized
ggucuucuguggagaggaugcug

SEQ ID NO: 5468 - RNA, 23 nt, artificial
  Completely synthesized
gucuucuguggagaggaugcugc

SEQ ID NO: 5469 - RNA, 23 nt, artificial
  Completely synthesized
ucuucuguggagaggaugcugcu

SEQ ID NO: 5470 - RNA, 23 nt, artificial
  Completely synthesized
cuucuguggagaggaugcugcug

SEQ ID NO: 5471 - RNA, 23 nt, artificial
  Completely synthesized
uucuguggagaggaugcugcuga

SEQ ID NO: 5472 - RNA, 23 nt, artificial
  Completely synthesized
auuaagacacuguaacucaggaa

SEQ ID NO: 5473 - RNA, 23 nt, artificial
  Completely synthesized
uggauaauagcuccucccaaacu

SEQ ID NO: 5474 - RNA, 23 nt, artificial
  Completely synthesized
ggauaauagcuccucccaaacuu

SEQ ID NO: 5475 - RNA, 23 nt, artificial
  Completely synthesized
gauaauagcuccucccaaacuug

SEQ ID NO: 5476 - RNA, 23 nt, artificial
  Completely synthesized
ugcauaccgucuaaaucaacagg

SEQ ID NO: 5477 - RNA, 23 nt, artificial
  Completely synthesized
gcauaccgucuaaaucaacaggg

SEQ ID NO: 5478 - RNA, 23 nt, artificial
  Completely synthesized
cauaccgucuaaaucaacagggg

SEQ ID NO: 5479 - RNA, 23 nt, artificial
  Completely synthesized
auaccgucuaaaucaacaggggc

SEQ ID NO: 5480 - RNA, 23 nt, artificial
  Completely synthesized
uaccgucuaaaucaacaggggcu

SEQ ID NO: 5481 - RNA, 23 nt, artificial
  Completely synthesized
agcaaugaagacugggcucucga

SEQ ID NO: 5482 - RNA, 23 nt, artificial
  Completely synthesized
gcaaugaagacugggcucucgau

SEQ ID NO: 5483 - RNA, 23 nt, artificial
  Completely synthesized
caaugaagacugggcucucgaug

SEQ ID NO: 5484 - RNA, 23 nt, artificial
  Completely synthesized
aaugaagacugggcucucgaugu

SEQ ID NO: 5485 - RNA, 23 nt, artificial
  Completely synthesized
augaagacugggcucucgaugug

SEQ ID NO: 5486 - RNA, 23 nt, artificial
  Completely synthesized
aacaagugacugaaacguagccg

SEQ ID NO: 5487 - RNA, 23 nt, artificial
  Completely synthesized
acaagugacugaaacguagccga

SEQ ID NO: 5488 - RNA, 23 nt, artificial
  Completely synthesized
caagugacugaaacguagccgaa

SEQ ID NO: 5489 - RNA, 23 nt, artificial
  Completely synthesized
aagugacugaaacguagccgaag

SEQ ID NO: 5490 - RNA, 23 nt, artificial
  Completely synthesized
agugacugaaacguagccgaaga

SEQ ID NO: 5491 - RNA, 23 nt, artificial
  Completely synthesized
acguagccgaagaaaccucauug

SEQ ID NO: 5492 - RNA, 23 nt, artificial
  Completely synthesized
cguagccgaagaaaccucauugu

SEQ ID NO: 5493 - RNA, 23 nt, artificial
  Completely synthesized
guagccgaagaaaccucauuguc

SEQ ID NO: 5494 - RNA, 23 nt, artificial
  Completely synthesized
uagccgaagaaaccucauuguca

SEQ ID NO: 5495 - RNA, 23 nt, artificial
  Completely synthesized
agccgaagaaaccucauugucau

SEQ ID NO: 5496 - RNA, 23 nt, artificial
  Completely synthesized
cuccuuuuggaguuguucuuguc

SEQ ID NO: 5497 - RNA, 23 nt, artificial
  Completely synthesized
ucaaguuuuuucuguuuuuccag

SEQ ID NO: 5498 - RNA, 23 nt, artificial
  Completely synthesized
cagcuccaaguccaucaugauga

SEQ ID NO: 5499 - RNA, 23 nt, artificial
  Completely synthesized
agcuccaaguccaucaugaugag

SEQ ID NO: 5500 - RNA, 23 nt, artificial
  Completely synthesized
gcuccaaguccaucaugaugagc

SEQ ID NO: 5501 - RNA, 23 nt, artificial
  Completely synthesized
cuccaaguccaucaugaugagcu

SEQ ID NO: 5502 - RNA, 23 nt, artificial
  Completely synthesized
uccaaguccaucaugaugagcug

SEQ ID NO: 5503 - RNA, 23 nt, artificial
  Completely synthesized
augauuuuuucuacagggaaugg

SEQ ID NO: 5504 - RNA, 23 nt, artificial
  Completely synthesized
ugacaaggguuguaccauauccc

SEQ ID NO: 5505 - RNA, 23 nt, artificial
  Completely synthesized
gacaaggguuguaccauaucccc

SEQ ID NO: 5506 - RNA, 23 nt, artificial
  Completely synthesized
acaaggguuguaccauaucccca

SEQ ID NO: 5507 - RNA, 23 nt, artificial
  Completely synthesized
caaggguuguaccauauccccag

SEQ ID NO: 5508 - RNA, 23 nt, artificial
  Completely synthesized
aaggguuguaccauauccccaga

SEQ ID NO: 5509 - RNA, 23 nt, artificial
  Completely synthesized
gggcacuaucuagcucuuccacu

SEQ ID NO: 5510 - RNA, 23 nt, artificial
  Completely synthesized
ggcacuaucuagcucuuccacuu

SEQ ID NO: 5511 - RNA, 23 nt, artificial
  Completely synthesized
gcacuaucuagcucuuccacuuc

SEQ ID NO: 5512 - RNA, 23 nt, artificial
  Completely synthesized
cacuaucuagcucuuccacuuca

SEQ ID NO: 5513 - RNA, 23 nt, artificial
  Completely synthesized
uccacugaguguucuggugaugc

SEQ ID NO: 5514 - RNA, 23 nt, artificial
  Completely synthesized
ccacugaguguucuggugaugcc

SEQ ID NO: 5515 - RNA, 23 nt, artificial
  Completely synthesized
cacugaguguucuggugaugcca

SEQ ID NO: 5516 - RNA, 23 nt, artificial
  Completely synthesized
acugaguguucuggugaugccac

SEQ ID NO: 5517 - RNA, 23 nt, artificial
  Completely synthesized
cugaguguucuggugaugccaca

SEQ ID NO: 5518 - RNA, 23 nt, artificial
  Completely synthesized
acaguuaccuacuucuuuuucca

SEQ ID NO: 5519 - RNA, 23 nt, artificial
  Completely synthesized
caguuaccuacuucuuuuuccau

SEQ ID NO: 5520 - RNA, 23 nt, artificial
  Completely synthesized
aguuaccuacuucuuuuuccauu

SEQ ID NO: 5521 - RNA, 23 nt, artificial
  Completely synthesized
guuaccuacuucuuuuuccauug

SEQ ID NO: 5522 - RNA, 23 nt, artificial
  Completely synthesized
uuaccuacuucuuuuuccauuga

SEQ ID NO: 5523 - RNA, 23 nt, artificial
  Completely synthesized
uggaaccaugguagucucaacca

SEQ ID NO: 5524 - RNA, 23 nt, artificial
  Completely synthesized
ggaaccaugguagucucaaccag

SEQ ID NO: 5525 - RNA, 23 nt, artificial
  Completely synthesized
gaaccaugguagucucaaccagc

SEQ ID NO: 5526 - RNA, 23 nt, artificial
  Completely synthesized
aaccaugguagucucaaccagcu

SEQ ID NO: 5527 - RNA, 23 nt, artificial
  Completely synthesized
cgggaauaucaggaacaagugac

SEQ ID NO: 5528 - RNA, 23 nt, artificial
  Completely synthesized
gggaauaucaggaacaagugacu

SEQ ID NO: 5529 - RNA, 23 nt, artificial
  Completely synthesized
ggaauaucaggaacaagugacug

SEQ ID NO: 5530 - RNA, 23 nt, artificial
  Completely synthesized
gaauaucaggaacaagugacuga

SEQ ID NO: 5531 - RNA, 23 nt, artificial
  Completely synthesized
aauaucaggaacaagugacugaa

SEQ ID NO: 5532 - RNA, 23 nt, artificial
  Completely synthesized
ugucaucuacaaacgggaauguc

SEQ ID NO: 5533 - RNA, 23 nt, artificial
  Completely synthesized
cuacaaacgggaaugucugcgcc

SEQ ID NO: 5534 - RNA, 23 nt, artificial
  Completely synthesized
uacaaacgggaaugucugcgcca

SEQ ID NO: 5535 - RNA, 23 nt, artificial
  Completely synthesized
acaaacgggaaugucugcgccaa

SEQ ID NO: 5536 - RNA, 23 nt, artificial
  Completely synthesized
gucaucaaaguacaaagcaucug

SEQ ID NO: 5537 - RNA, 23 nt, artificial
  Completely synthesized
ucaucaaaguacaaagcaucuga

SEQ ID NO: 5538 - RNA, 23 nt, artificial
  Completely synthesized
caucaaaguacaaagcaucugau

SEQ ID NO: 5539 - RNA, 23 nt, artificial
  Completely synthesized
aucaaaguacaaagcaucugauu

SEQ ID NO: 5540 - RNA, 23 nt, artificial
  Completely synthesized
ucaaaguacaaagcaucugauuu

SEQ ID NO: 5541 - RNA, 23 nt, artificial
  Completely synthesized
cugauuugggaaugugggcaacc

SEQ ID NO: 5542 - RNA, 23 nt, artificial
  Completely synthesized
ugauuugggaaugugggcaaccu

SEQ ID NO: 5543 - RNA, 23 nt, artificial
  Completely synthesized
gauuugggaaugugggcaaccug

SEQ ID NO: 5544 - RNA, 23 nt, artificial
  Completely synthesized
auuugggaaugugggcaaccugg

SEQ ID NO: 5545 - RNA, 23 nt, artificial
  Completely synthesized
uuugggaaugugggcaaccuggg

SEQ ID NO: 5546 - RNA, 23 nt, artificial
  Completely synthesized
gucucuucaucuaguuguaacug

SEQ ID NO: 5547 - RNA, 23 nt, artificial
  Completely synthesized
ucucuucaucuaguuguaacuga

SEQ ID NO: 5548 - RNA, 23 nt, artificial
  Completely synthesized
cucuucaucuaguuguaacugag

SEQ ID NO: 5549 - RNA, 23 nt, artificial
  Completely synthesized
ucuucaucuaguuguaacugagc

SEQ ID NO: 5550 - RNA, 23 nt, artificial
  Completely synthesized
uuauuaguaccagcucuuaaaau

SEQ ID NO: 5551 - RNA, 23 nt, artificial
  Completely synthesized
uauuaguaccagcucuuaaaauu

SEQ ID NO: 5552 - RNA, 23 nt, artificial
  Completely synthesized
acuaguuuuggcuaugauuuugc

SEQ ID NO: 5553 - RNA, 23 nt, artificial
  Completely synthesized
cuaguuuuggcuaugauuuugca

SEQ ID NO: 5554 - RNA, 23 nt, artificial
  Completely synthesized
uaguuuuggcuaugauuuugcau

SEQ ID NO: 5555 - RNA, 23 nt, artificial
  Completely synthesized
cacaucacaguaggagcuuuuag

SEQ ID NO: 5556 - RNA, 23 nt, artificial
  Completely synthesized
acaucacaguaggagcuuuuagu

SEQ ID NO: 5557 - RNA, 23 nt, artificial
  Completely synthesized
caucacaguaggagcuuuuagua

SEQ ID NO: 5558 - RNA, 23 nt, artificial
  Completely synthesized
aucacaguaggagcuuuuaguau

SEQ ID NO: 5559 - RNA, 23 nt, artificial
  Completely synthesized
ucacaguaggagcuuuuaguaua

SEQ ID NO: 5560 - RNA, 23 nt, artificial
  Completely synthesized
uuggaguuguucuugucuuuccu

SEQ ID NO: 5561 - RNA, 23 nt, artificial
  Completely synthesized
ucuccuuuuucuuugagcaauuu

SEQ ID NO: 5562 - RNA, 23 nt, artificial
  Completely synthesized
cccgaauuaaugcaaguugagcu

SEQ ID NO: 5563 - RNA, 23 nt, artificial
  Completely synthesized
ccgaauuaaugcaaguugagcuu

SEQ ID NO: 5564 - RNA, 23 nt, artificial
  Completely synthesized
cgaauuaaugcaaguugagcuuc

SEQ ID NO: 5565 - RNA, 23 nt, artificial
  Completely synthesized
gaauuaaugcaaguugagcuuca

SEQ ID NO: 5566 - RNA, 23 nt, artificial
  Completely synthesized
aauuaaugcaaguugagcuucau

SEQ ID NO: 5567 - RNA, 23 nt, artificial
  Completely synthesized
auuaaugcaaguugagcuucauu

SEQ ID NO: 5568 - RNA, 23 nt, artificial
  Completely synthesized
guguucucacauugggcaucaug

SEQ ID NO: 5569 - RNA, 23 nt, artificial
  Completely synthesized
uguucucacauugggcaucaugc

SEQ ID NO: 5570 - RNA, 23 nt, artificial
  Completely synthesized
guucucacauugggcaucaugca

SEQ ID NO: 5571 - RNA, 23 nt, artificial
  Completely synthesized
uucucacauugggcaucaugcac

SEQ ID NO: 5572 - RNA, 23 nt, artificial
  Completely synthesized
guguuuagugaaaugccggaguc

SEQ ID NO: 5573 - RNA, 23 nt, artificial
  Completely synthesized
uguuuagugaaaugccggaguca

SEQ ID NO: 5574 - RNA, 23 nt, artificial
  Completely synthesized
guuuagugaaaugccggagucag

SEQ ID NO: 5575 - RNA, 23 nt, artificial
  Completely synthesized
uuuagugaaaugccggagucaga

SEQ ID NO: 5576 - RNA, 23 nt, artificial
  Completely synthesized
uuagugaaaugccggagucagaa

SEQ ID NO: 5577 - RNA, 23 nt, artificial
  Completely synthesized
ucagaaucauugaauucugcugu

SEQ ID NO: 5578 - RNA, 23 nt, artificial
  Completely synthesized
cagaaucauugaauucugcugug

SEQ ID NO: 5579 - RNA, 23 nt, artificial
  Completely synthesized
agaaucauugaauucugcugugc

SEQ ID NO: 5580 - RNA, 23 nt, artificial
  Completely synthesized
gaaucauugaauucugcugugcu

SEQ ID NO: 5581 - RNA, 23 nt, artificial
  Completely synthesized
aaucauugaauucugcugugcuu

SEQ ID NO: 5582 - RNA, 23 nt, artificial
  Completely synthesized
ggggucuucuguggagaggaugc

SEQ ID NO: 5583 - RNA, 23 nt, artificial
  Completely synthesized
gggucuucuguggagaggaugcu

SEQ ID NO: 5584 - RNA, 23 nt, artificial
  Completely synthesized
gaaaauguggacuacaguuaccu

SEQ ID NO: 5585 - RNA, 23 nt, artificial
  Completely synthesized
aaaauguggacuacaguuaccua

SEQ ID NO: 5586 - RNA, 23 nt, artificial
  Completely synthesized
aaauguggacuacaguuaccuac

SEQ ID NO: 5587 - RNA, 23 nt, artificial
  Completely synthesized
aauguggacuacaguuaccuacu

SEQ ID NO: 5588 - RNA, 23 nt, artificial
  Completely synthesized
auguggacuacaguuaccuacuu

SEQ ID NO: 5589 - RNA, 23 nt, artificial
  Completely synthesized
guccuguugcauaccgucuaaau

SEQ ID NO: 5590 - RNA, 23 nt, artificial
  Completely synthesized
uccuguugcauaccgucuaaauc

SEQ ID NO: 5591 - RNA, 23 nt, artificial
  Completely synthesized
gggaaugucugcgccaaaagcug

SEQ ID NO: 5592 - RNA, 23 nt, artificial
  Completely synthesized
ggaaugucugcgccaaaagcugc

SEQ ID NO: 5593 - RNA, 23 nt, artificial
  Completely synthesized
gaaugucugcgccaaaagcugca

SEQ ID NO: 5594 - RNA, 23 nt, artificial
  Completely synthesized
aaugucugcgccaaaagcugcau

SEQ ID NO: 5595 - RNA, 23 nt, artificial
  Completely synthesized
augucugcgccaaaagcugcaug

SEQ ID NO: 5596 - RNA, 23 nt, artificial
  Completely synthesized
aaaaugccauuuuuuguccauac

SEQ ID NO: 5597 - RNA, 23 nt, artificial
  Completely synthesized
aaaugccauuuuuuguccauaca

SEQ ID NO: 5598 - RNA, 23 nt, artificial
  Completely synthesized
aaugccauuuuuuguccauacag

SEQ ID NO: 5599 - RNA, 23 nt, artificial
  Completely synthesized
augccauuuuuuguccauacagu

SEQ ID NO: 5600 - RNA, 23 nt, artificial
  Completely synthesized
ugccauuuuuuguccauacagua

SEQ ID NO: 5601 - RNA, 23 nt, artificial
  Completely synthesized
auaguacaaaaaaacuagcucag

SEQ ID NO: 5602 - RNA, 23 nt, artificial
  Completely synthesized
uaguacaaaaaaacuagcucaga

SEQ ID NO: 5603 - RNA, 23 nt, artificial
  Completely synthesized
aguacaaaaaaacuagcucagaa

SEQ ID NO: 5604 - RNA, 23 nt, artificial
  Completely synthesized
guacaaaaaaacuagcucagaaa

SEQ ID NO: 5605 - RNA, 23 nt, artificial
  Completely synthesized
uacaaaaaaacuagcucagaaaa

SEQ ID NO: 5606 - RNA, 23 nt, artificial
  Completely synthesized
gcucagaaaaggucaaauccucc

SEQ ID NO: 5607 - RNA, 23 nt, artificial
  Completely synthesized
cucagaaaaggucaaauccuccu

SEQ ID NO: 5608 - RNA, 23 nt, artificial
  Completely synthesized
ucagaaaaggucaaauccuccua

SEQ ID NO: 5609 - RNA, 23 nt, artificial
  Completely synthesized
cagaaaaggucaaauccuccuaa

SEQ ID NO: 5610 - RNA, 23 nt, artificial
  Completely synthesized
agaaaaggucaaauccuccuaaa

SEQ ID NO: 5611 - RNA, 23 nt, artificial
  Completely synthesized
uuuucaguaggugaaggcuuuug

SEQ ID NO: 5612 - RNA, 23 nt, artificial
  Completely synthesized
uuucaguaggugaaggcuuuugu

SEQ ID NO: 5613 - RNA, 23 nt, artificial
  Completely synthesized
ugaucuaaaucuugcucuaguuc

SEQ ID NO: 5614 - RNA, 23 nt, artificial
  Completely synthesized
cuugcucuaguucuacuauauuu

SEQ ID NO: 5615 - RNA, 23 nt, artificial
  Completely synthesized
uugcucuaguucuacuauauuuu

SEQ ID NO: 5616 - RNA, 23 nt, artificial
  Completely synthesized
uccaucaugaugagcuguggacc

SEQ ID NO: 5617 - RNA, 23 nt, artificial
  Completely synthesized
ccaucaugaugagcuguggaccg

SEQ ID NO: 5618 - RNA, 23 nt, artificial
  Completely synthesized
caucaugaugagcuguggaccgu

SEQ ID NO: 5619 - RNA, 23 nt, artificial
  Completely synthesized
aucaugaugagcuguggaccgug

SEQ ID NO: 5620 - RNA, 23 nt, artificial
  Completely synthesized
ucaugaugagcuguggaccgugu

SEQ ID NO: 5621 - RNA, 23 nt, artificial
  Completely synthesized
gaccauucuguuugacacuucca

SEQ ID NO: 5622 - RNA, 23 nt, artificial
  Completely synthesized
cuagcucuuccacuucagaauca

SEQ ID NO: 5623 - RNA, 23 nt, artificial
  Completely synthesized
uagcucuuccacuucagaaucac

SEQ ID NO: 5624 - RNA, 23 nt, artificial
  Completely synthesized
uguguuuagugaaaugccggagu

SEQ ID NO: 5625 - RNA, 23 nt, artificial
  Completely synthesized
uugcaaagugauagaucagaaac

SEQ ID NO: 5626 - RNA, 23 nt, artificial
  Completely synthesized
acuucucgacuuacuccaagauc

SEQ ID NO: 5627 - RNA, 23 nt, artificial
  Completely synthesized
uacuucuuuuuccauugagggua

SEQ ID NO: 5628 - RNA, 23 nt, artificial
  Completely synthesized
acuucuuuuuccauugaggguau

SEQ ID NO: 5629 - RNA, 23 nt, artificial
  Completely synthesized
cuucuuuuuccauugaggguaua

SEQ ID NO: 5630 - RNA, 23 nt, artificial
  Completely synthesized
uucuuuuuccauugaggguauag

SEQ ID NO: 5631 - RNA, 23 nt, artificial
  Completely synthesized
ucuuuuuccauugaggguauaga

SEQ ID NO: 5632 - RNA, 23 nt, artificial
  Completely synthesized
uggacuuggaaccaugguagucu

SEQ ID NO: 5633 - RNA, 23 nt, artificial
  Completely synthesized
ucgaugugaccgggaauaucagg

SEQ ID NO: 5634 - RNA, 23 nt, artificial
  Completely synthesized
cgaugugaccgggaauaucagga

SEQ ID NO: 5635 - RNA, 23 nt, artificial
  Completely synthesized
gaugugaccgggaauaucaggaa

SEQ ID NO: 5636 - RNA, 23 nt, artificial
  Completely synthesized
augugaccgggaauaucaggaac

SEQ ID NO: 5637 - RNA, 23 nt, artificial
  Completely synthesized
ugugaccgggaauaucaggaaca

SEQ ID NO: 5638 - RNA, 23 nt, artificial
  Completely synthesized
aaaccucauugucaucuacaaac

SEQ ID NO: 5639 - RNA, 23 nt, artificial
  Completely synthesized
aaccucauugucaucuacaaacg

SEQ ID NO: 5640 - RNA, 23 nt, artificial
  Completely synthesized
accucauugucaucuacaaacgg

SEQ ID NO: 5641 - RNA, 23 nt, artificial
  Completely synthesized
ccucauugucaucuacaaacggg

SEQ ID NO: 5642 - RNA, 23 nt, artificial
  Completely synthesized
ugggaguaguuggcagauccacu

SEQ ID NO: 5643 - RNA, 23 nt, artificial
  Completely synthesized
gggaguaguuggcagauccacug

SEQ ID NO: 5644 - RNA, 23 nt, artificial
  Completely synthesized
ggaguaguuggcagauccacugg

SEQ ID NO: 5645 - RNA, 23 nt, artificial
  Completely synthesized
gaguaguuggcagauccacuggu

SEQ ID NO: 5646 - RNA, 23 nt, artificial
  Completely synthesized
aguaguuggcagauccacugguu

SEQ ID NO: 5647 - RNA, 23 nt, artificial
  Completely synthesized
agaaauucaccugucucuucauc

SEQ ID NO: 5648 - RNA, 23 nt, artificial
  Completely synthesized
aggaaaacauugccaucucuugu

SEQ ID NO: 5649 - RNA, 23 nt, artificial
  Completely synthesized
ggaaaacauugccaucucuuguu

SEQ ID NO: 5650 - RNA, 23 nt, artificial
  Completely synthesized
gaaaacauugccaucucuuguuu

SEQ ID NO: 5651 - RNA, 23 nt, artificial
  Completely synthesized
aaaacauugccaucucuuguuug

SEQ ID NO: 5652 - RNA, 23 nt, artificial
  Completely synthesized
aaacauugccaucucuuguuugc

SEQ ID NO: 5653 - RNA, 23 nt, artificial
  Completely synthesized
caucucuuguuugcugcagggag

SEQ ID NO: 5654 - RNA, 23 nt, artificial
  Completely synthesized
aucucuuguuugcugcagggagu

SEQ ID NO: 5655 - RNA, 23 nt, artificial
  Completely synthesized
ucucuuguuugcugcagggagua

SEQ ID NO: 5656 - RNA, 23 nt, artificial
  Completely synthesized
cucuuguuugcugcagggaguau

SEQ ID NO: 5657 - RNA, 23 nt, artificial
  Completely synthesized
ucuuguuugcugcagggaguauu

SEQ ID NO: 5658 - RNA, 23 nt, artificial
  Completely synthesized
gaguauucacuaggagaauaagg

SEQ ID NO: 5659 - RNA, 23 nt, artificial
  Completely synthesized
ggagaauaagguuuuccaucuuc

SEQ ID NO: 5660 - RNA, 23 nt, artificial
  Completely synthesized
ucguugaagucaacaacagggag

SEQ ID NO: 5661 - RNA, 23 nt, artificial
  Completely synthesized
cguugaagucaacaacagggagg

SEQ ID NO: 5662 - RNA, 23 nt, artificial
  Completely synthesized
guugaagucaacaacagggaggu

SEQ ID NO: 5663 - RNA, 23 nt, artificial
  Completely synthesized
uugaagucaacaacagggagguu

SEQ ID NO: 5664 - RNA, 23 nt, artificial
  Completely synthesized
uuucuacagggaaugggauaugg

SEQ ID NO: 5665 - RNA, 23 nt, artificial
  Completely synthesized
uucuacagggaaugggauaugga

SEQ ID NO: 5666 - RNA, 23 nt, artificial
  Completely synthesized
ucuacagggaaugggauauggag

SEQ ID NO: 5667 - RNA, 23 nt, artificial
  Completely synthesized
cuacagggaaugggauauggaga

SEQ ID NO: 5668 - RNA, 23 nt, artificial
  Completely synthesized
uacagggaaugggauauggagag

SEQ ID NO: 5669 - RNA, 23 nt, artificial
  Completely synthesized
cgacuuacuccaagaucuauauc

SEQ ID NO: 5670 - RNA, 23 nt, artificial
  Completely synthesized
gcauuaagaaaauguggacuaca

SEQ ID NO: 5671 - RNA, 23 nt, artificial
  Completely synthesized
cauuaagaaaauguggacuacag

SEQ ID NO: 5672 - RNA, 23 nt, artificial
  Completely synthesized
auuaagaaaauguggacuacagu

SEQ ID NO: 5673 - RNA, 23 nt, artificial
  Completely synthesized
uuaagaaaauguggacuacaguu

SEQ ID NO: 5674 - RNA, 23 nt, artificial
  Completely synthesized
uaagaaaauguggacuacaguua

SEQ ID NO: 5675 - RNA, 23 nt, artificial
  Completely synthesized
uccauugaggguauagaugagua

SEQ ID NO: 5676 - RNA, 23 nt, artificial
  Completely synthesized
ccauugaggguauagaugaguaa

SEQ ID NO: 5677 - RNA, 23 nt, artificial
  Completely synthesized
cauugaggguauagaugaguaaa

SEQ ID NO: 5678 - RNA, 23 nt, artificial
  Completely synthesized
auugaggguauagaugaguaaaa

SEQ ID NO: 5679 - RNA, 23 nt, artificial
  Completely synthesized
uugaggguauagaugaguaaaaa

SEQ ID NO: 5680 - RNA, 23 nt, artificial
  Completely synthesized
acugaaacguagccgaagaaacc

SEQ ID NO: 5681 - RNA, 23 nt, artificial
  Completely synthesized
cugaaacguagccgaagaaaccu

SEQ ID NO: 5682 - RNA, 23 nt, artificial
  Completely synthesized
ugaaacguagccgaagaaaccuc

SEQ ID NO: 5683 - RNA, 23 nt, artificial
  Completely synthesized
gaaacguagccgaagaaaccuca

SEQ ID NO: 5684 - RNA, 23 nt, artificial
  Completely synthesized
aaacguagccgaagaaaccucau

SEQ ID NO: 5685 - RNA, 23 nt, artificial
  Completely synthesized
gcugaauugggagaaauucaccu

SEQ ID NO: 5686 - RNA, 23 nt, artificial
  Completely synthesized
aauaauuucuuuuuagccagaug

SEQ ID NO: 5687 - RNA, 23 nt, artificial
  Completely synthesized
ccaaaugguguccuaagaaauug

SEQ ID NO: 5688 - RNA, 23 nt, artificial
  Completely synthesized
caaaugguguccuaagaaauugu

SEQ ID NO: 5689 - RNA, 23 nt, artificial
  Completely synthesized
aaaugguguccuaagaaauuguu

SEQ ID NO: 5690 - RNA, 23 nt, artificial
  Completely synthesized
aaugguguccuaagaaauuguuu

SEQ ID NO: 5691 - RNA, 23 nt, artificial
  Completely synthesized
augguguccuaagaaauuguuua

SEQ ID NO: 5692 - RNA, 23 nt, artificial
  Completely synthesized
ucaacauacugacacuccaaugc

SEQ ID NO: 5693 - RNA, 23 nt, artificial
  Completely synthesized
aaggaaaacauugccaucucuug

SEQ ID NO: 5694 - RNA, 23 nt, artificial
  Completely synthesized
acauugccaucucuuguuugcug

SEQ ID NO: 5695 - RNA, 23 nt, artificial
  Completely synthesized
cauugccaucucuuguuugcugc

SEQ ID NO: 5696 - RNA, 23 nt, artificial
  Completely synthesized
auugccaucucuuguuugcugca

SEQ ID NO: 5697 - RNA, 23 nt, artificial
  Completely synthesized
uugccaucucuuguuugcugcag

SEQ ID NO: 5698 - RNA, 23 nt, artificial
  Completely synthesized
ugccaucucuuguuugcugcagg

SEQ ID NO: 5699 - RNA, 23 nt, artificial
  Completely synthesized
uucaaaugaucuaaaucuugcuc

SEQ ID NO: 5700 - RNA, 23 nt, artificial
  Completely synthesized
agucaacaacagggagguuaaug

SEQ ID NO: 5701 - RNA, 23 nt, artificial
  Completely synthesized
gucaacaacagggagguuaauga

SEQ ID NO: 5702 - RNA, 23 nt, artificial
  Completely synthesized
ucaacaacagggagguuaaugau

SEQ ID NO: 5703 - RNA, 23 nt, artificial
  Completely synthesized
caacaacagggagguuaaugauu

SEQ ID NO: 5704 - RNA, 23 nt, artificial
  Completely synthesized
aacaacagggagguuaaugauuu

SEQ ID NO: 5705 - RNA, 23 nt, artificial
  Completely synthesized
uauggagagcuuuugcccuaagu

SEQ ID NO: 5706 - RNA, 23 nt, artificial
  Completely synthesized
cuguuugacacuuccaggggcac

SEQ ID NO: 5707 - RNA, 23 nt, artificial
  Completely synthesized
cuuuuuccauugaggguauagau

SEQ ID NO: 5708 - RNA, 23 nt, artificial
  Completely synthesized
uuuuuccauugaggguauagaug

SEQ ID NO: 5709 - RNA, 23 nt, artificial
  Completely synthesized
uuuuccauugaggguauagauga

SEQ ID NO: 5710 - RNA, 23 nt, artificial
  Completely synthesized
uuuccauugaggguauagaugag

SEQ ID NO: 5711 - RNA, 23 nt, artificial
  Completely synthesized
ucugucaguuuggcuucuggacu

SEQ ID NO: 5712 - RNA, 23 nt, artificial
  Completely synthesized
cugucaguuuggcuucuggacuu

SEQ ID NO: 5713 - RNA, 23 nt, artificial
  Completely synthesized
ugucaguuuggcuucuggacuug

SEQ ID NO: 5714 - RNA, 23 nt, artificial
  Completely synthesized
gucaguuuggcuucuggacuugg

SEQ ID NO: 5715 - RNA, 23 nt, artificial
  Completely synthesized
caaguccaucaugaugagcugug

SEQ ID NO: 5716 - RNA, 23 nt, artificial
  Completely synthesized
aaguccaucaugaugagcugugg

SEQ ID NO: 5717 - RNA, 23 nt, artificial
  Completely synthesized
aguccaucaugaugagcugugga

SEQ ID NO: 5718 - RNA, 23 nt, artificial
  Completely synthesized
guccaucaugaugagcuguggac

SEQ ID NO: 5719 - RNA, 23 nt, artificial
  Completely synthesized
uuaagacacuguaacucaggaau

SEQ ID NO: 5720 - RNA, 23 nt, artificial
  Completely synthesized
uaagacacuguaacucaggaaug

SEQ ID NO: 5721 - RNA, 23 nt, artificial
  Completely synthesized
ccucccaaacuugcucaaugucc

SEQ ID NO: 5722 - RNA, 23 nt, artificial
  Completely synthesized
cucccaaacuugcucaauguccu

SEQ ID NO: 5723 - RNA, 23 nt, artificial
  Completely synthesized
ucccaaacuugcucaauguccug

SEQ ID NO: 5724 - RNA, 23 nt, artificial
  Completely synthesized
cccaaacuugcucaauguccugu

SEQ ID NO: 5725 - RNA, 23 nt, artificial
  Completely synthesized
ccaaacuugcucaauguccuguu

SEQ ID NO: 5726 - RNA, 23 nt, artificial
  Completely synthesized
guaguuggcagauccacugguuu

SEQ ID NO: 5727 - RNA, 23 nt, artificial
  Completely synthesized
uaguuggcagauccacugguuuc

SEQ ID NO: 5728 - RNA, 23 nt, artificial
  Completely synthesized
aguuggcagauccacugguuucu

SEQ ID NO: 5729 - RNA, 23 nt, artificial
  Completely synthesized
guuggcagauccacugguuucug

SEQ ID NO: 5730 - RNA, 23 nt, artificial
  Completely synthesized
uuggcagauccacugguuucuga

SEQ ID NO: 5731 - RNA, 23 nt, artificial
  Completely synthesized
auuaguaccagcucuuaaaauuu

SEQ ID NO: 5732 - RNA, 23 nt, artificial
  Completely synthesized
ucuauacuaguuuuggcuaugau

SEQ ID NO: 5733 - RNA, 23 nt, artificial
  Completely synthesized
cuauacuaguuuuggcuaugauu

SEQ ID NO: 5734 - RNA, 23 nt, artificial
  Completely synthesized
uauacuaguuuuggcuaugauuu

SEQ ID NO: 5735 - RNA, 23 nt, artificial
  Completely synthesized
aaaguaugagcauuucacaucac

SEQ ID NO: 5736 - RNA, 23 nt, artificial
  Completely synthesized
aaguaugagcauuucacaucaca

SEQ ID NO: 5737 - RNA, 23 nt, artificial
  Completely synthesized
gcuucuuacuuuugggaacaagg

SEQ ID NO: 5738 - RNA, 23 nt, artificial
  Completely synthesized
cuucuuacuuuugggaacaagga

SEQ ID NO: 5739 - RNA, 23 nt, artificial
  Completely synthesized
uucuuacuuuugggaacaaggaa

SEQ ID NO: 5740 - RNA, 23 nt, artificial
  Completely synthesized
ucuuacuuuugggaacaaggaaa

SEQ ID NO: 5741 - RNA, 23 nt, artificial
  Completely synthesized
cuuacuuuugggaacaaggaaaa

SEQ ID NO: 5742 - RNA, 23 nt, artificial
  Completely synthesized
aacauugccaucucuuguuugcu

SEQ ID NO: 5743 - RNA, 23 nt, artificial
  Completely synthesized
aaacuucgagauauaaggugcug

SEQ ID NO: 5744 - RNA, 23 nt, artificial
  Completely synthesized
aacuucgagauauaaggugcuga

SEQ ID NO: 5745 - RNA, 23 nt, artificial
  Completely synthesized
acuucgagauauaaggugcugag

SEQ ID NO: 5746 - RNA, 23 nt, artificial
  Completely synthesized
cuucgagauauaaggugcugagu

SEQ ID NO: 5747 - RNA, 23 nt, artificial
  Completely synthesized
uucgagauauaaggugcugaguu

SEQ ID NO: 5748 - RNA, 23 nt, artificial
  Completely synthesized
ucgagauauaaggugcugaguug

SEQ ID NO: 5749 - RNA, 23 nt, artificial
  Completely synthesized
ggcaucaugcacgugagugcucu

SEQ ID NO: 5750 - RNA, 23 nt, artificial
  Completely synthesized
gcaucaugcacgugagugcucug

SEQ ID NO: 5751 - RNA, 23 nt, artificial
  Completely synthesized
caucaugcacgugagugcucugc

SEQ ID NO: 5752 - RNA, 23 nt, artificial
  Completely synthesized
aucaugcacgugagugcucugcc

SEQ ID NO: 5753 - RNA, 23 nt, artificial
  Completely synthesized
ucaugcacgugagugcucugccc

SEQ ID NO: 5754 - RNA, 23 nt, artificial
  Completely synthesized
uugguugaaagcuuugcaaagug

SEQ ID NO: 5755 - RNA, 23 nt, artificial
  Completely synthesized
ugguugaaagcuuugcaaaguga

SEQ ID NO: 5756 - RNA, 23 nt, artificial
  Completely synthesized
gguugaaagcuuugcaaagugau

SEQ ID NO: 5757 - RNA, 23 nt, artificial
  Completely synthesized
guugaaagcuuugcaaagugaua

SEQ ID NO: 5758 - RNA, 23 nt, artificial
  Completely synthesized
uugaaagcuuugcaaagugauag

SEQ ID NO: 5759 - RNA, 23 nt, artificial
  Completely synthesized
caccaaaaucuguguugacugug

SEQ ID NO: 5760 - RNA, 23 nt, artificial
  Completely synthesized
accaaaaucuguguugacugugg

SEQ ID NO: 5761 - RNA, 23 nt, artificial
  Completely synthesized
ccaaaaucuguguugacuguggc

SEQ ID NO: 5762 - RNA, 23 nt, artificial
  Completely synthesized
caaaaucuguguugacuguggca

SEQ ID NO: 5763 - RNA, 23 nt, artificial
  Completely synthesized
aaaaucuguguugacuguggcau

SEQ ID NO: 5764 - RNA, 23 nt, artificial
  Completely synthesized
uguguugacuguggcaucugaau

SEQ ID NO: 5765 - RNA, 23 nt, artificial
  Completely synthesized
guguugacuguggcaucugaauu

SEQ ID NO: 5766 - RNA, 23 nt, artificial
  Completely synthesized
uguugacuguggcaucugaauuu

SEQ ID NO: 5767 - RNA, 23 nt, artificial
  Completely synthesized
guugacuguggcaucugaauuua

SEQ ID NO: 5768 - RNA, 23 nt, artificial
  Completely synthesized
uugacuguggcaucugaauuuaa

SEQ ID NO: 5769 - RNA, 23 nt, artificial
  Completely synthesized
uaccuacuucuuuuuccauugag

SEQ ID NO: 5770 - RNA, 23 nt, artificial
  Completely synthesized
accuacuucuuuuuccauugagg

SEQ ID NO: 5771 - RNA, 23 nt, artificial
  Completely synthesized
ccuacuucuuuuuccauugaggg

SEQ ID NO: 5772 - RNA, 23 nt, artificial
  Completely synthesized
cuacuucuuuuuccauugagggu

SEQ ID NO: 5773 - RNA, 23 nt, artificial
  Completely synthesized
uggcagauccacugguuucugac

SEQ ID NO: 5774 - RNA, 23 nt, artificial
  Completely synthesized
ggagaaauucaccugucucuuca

SEQ ID NO: 5775 - RNA, 23 nt, artificial
  Completely synthesized
gagaaauucaccugucucuucau

SEQ ID NO: 5776 - RNA, 23 nt, artificial
  Completely synthesized
uacacuuacacagaaacuagccc

SEQ ID NO: 5777 - RNA, 23 nt, artificial
  Completely synthesized
ugaguguucuggugaugccacac

SEQ ID NO: 5778 - RNA, 23 nt, artificial
  Completely synthesized
gaguguucuggugaugccacacu

SEQ ID NO: 5779 - RNA, 23 nt, artificial
  Completely synthesized
agugaaaugccggagucagaauc

SEQ ID NO: 5780 - RNA, 23 nt, artificial
  Completely synthesized
gugaaaugccggagucagaauca

SEQ ID NO: 5781 - RNA, 23 nt, artificial
  Completely synthesized
ugaaaugccggagucagaaucau

SEQ ID NO: 5782 - RNA, 23 nt, artificial
  Completely synthesized
gaaaugccggagucagaaucauu

SEQ ID NO: 5783 - RNA, 23 nt, artificial
  Completely synthesized
aaaugccggagucagaaucauug

SEQ ID NO: 5784 - RNA, 23 nt, artificial
  Completely synthesized
ugaaagcuuugcaaagugauaga

SEQ ID NO: 5785 - RNA, 23 nt, artificial
  Completely synthesized
gaaagcuuugcaaagugauagau

SEQ ID NO: 5786 - RNA, 23 nt, artificial
  Completely synthesized
aaagcuuugcaaagugauagauc

SEQ ID NO: 5787 - RNA, 23 nt, artificial
  Completely synthesized
uuagaaguucagagagugaaugg

SEQ ID NO: 5788 - RNA, 23 nt, artificial
  Completely synthesized
aacuucugucaguuuggcuucug

SEQ ID NO: 5789 - RNA, 23 nt, artificial
  Completely synthesized
acuucugucaguuuggcuucugg

SEQ ID NO: 5790 - RNA, 23 nt, artificial
  Completely synthesized
cuucugucaguuuggcuucugga

SEQ ID NO: 5791 - RNA, 23 nt, artificial
  Completely synthesized
uucugucaguuuggcuucuggac

SEQ ID NO: 5792 - RNA, 23 nt, artificial
  Completely synthesized
uagcaaugaagacugggcucucg

SEQ ID NO: 5793 - RNA, 23 nt, artificial
  Completely synthesized
aagaaaccucauugucaucuaca

SEQ ID NO: 5794 - RNA, 23 nt, artificial
  Completely synthesized
agaaaccucauugucaucuacaa

SEQ ID NO: 5795 - RNA, 23 nt, artificial
  Completely synthesized
gaaaccucauugucaucuacaaa

SEQ ID NO: 5796 - RNA, 23 nt, artificial
  Completely synthesized
ugacacuccaaugcuuuuuaaag

SEQ ID NO: 5797 - RNA, 23 nt, artificial
  Completely synthesized
gacacuccaaugcuuuuuaaagu

SEQ ID NO: 5798 - RNA, 23 nt, artificial
  Completely synthesized
acacuccaaugcuuuuuaaaguu

SEQ ID NO: 5799 - RNA, 23 nt, artificial
  Completely synthesized
cacuccaaugcuuuuuaaaguuu

SEQ ID NO: 5800 - RNA, 23 nt, artificial
  Completely synthesized
acuccaaugcuuuuuaaaguuuc

SEQ ID NO: 5801 - RNA, 23 nt, artificial
  Completely synthesized
uacguauaucccgaauuaaugca

SEQ ID NO: 5802 - RNA, 23 nt, artificial
  Completely synthesized
acguauaucccgaauuaaugcaa

SEQ ID NO: 5803 - RNA, 23 nt, artificial
  Completely synthesized
cguauaucccgaauuaaugcaag

SEQ ID NO: 5804 - RNA, 23 nt, artificial
  Completely synthesized
guauaucccgaauuaaugcaagu

SEQ ID NO: 5805 - RNA, 23 nt, artificial
  Completely synthesized
uauaucccgaauuaaugcaaguu

SEQ ID NO: 5806 - RNA, 23 nt, artificial
  Completely synthesized
ggcaauucuuucucugguguguu

SEQ ID NO: 5807 - RNA, 23 nt, artificial
  Completely synthesized
gcucauacucuuuccgucgcuga

SEQ ID NO: 5808 - RNA, 23 nt, artificial
  Completely synthesized
ugacugaagucaaauacuucucg

SEQ ID NO: 5809 - RNA, 23 nt, artificial
  Completely synthesized
gacugaagucaaauacuucucga

SEQ ID NO: 5810 - RNA, 23 nt, artificial
  Completely synthesized
acugaagucaaauacuucucgac

SEQ ID NO: 5811 - RNA, 23 nt, artificial
  Completely synthesized
cugaagucaaauacuucucgacu

SEQ ID NO: 5812 - RNA, 23 nt, artificial
  Completely synthesized
ugaagucaaauacuucucgacuu

SEQ ID NO: 5813 - RNA, 23 nt, artificial
  Completely synthesized
aaaucuguguugacuguggcauc

SEQ ID NO: 5814 - RNA, 23 nt, artificial
  Completely synthesized
ugacuguggcaucugaauuuaau

SEQ ID NO: 5815 - RNA, 23 nt, artificial
  Completely synthesized
uguggacuacaguuaccuacuuc

SEQ ID NO: 5816 - RNA, 23 nt, artificial
  Completely synthesized
accaugguagucucaaccagcuu

SEQ ID NO: 5817 - RNA, 23 nt, artificial
  Completely synthesized
ccaugguagucucaaccagcuug

SEQ ID NO: 5818 - RNA, 23 nt, artificial
  Completely synthesized
caugguagucucaaccagcuugu

SEQ ID NO: 5819 - RNA, 23 nt, artificial
  Completely synthesized
acacuguaacucaggaauggaua

SEQ ID NO: 5820 - RNA, 23 nt, artificial
  Completely synthesized
cacuguaacucaggaauggauaa

SEQ ID NO: 5821 - RNA, 23 nt, artificial
  Completely synthesized
acuguaacucaggaauggauaau

SEQ ID NO: 5822 - RNA, 23 nt, artificial
  Completely synthesized
cuguaacucaggaauggauaaua

SEQ ID NO: 5823 - RNA, 23 nt, artificial
  Completely synthesized
uguaacucaggaauggauaauag

SEQ ID NO: 5824 - RNA, 23 nt, artificial
  Completely synthesized
auaucuugccuccaaaguauguc

SEQ ID NO: 5825 - RNA, 23 nt, artificial
  Completely synthesized
ccgaagaaaccucauugucaucu

SEQ ID NO: 5826 - RNA, 23 nt, artificial
  Completely synthesized
cgaagaaaccucauugucaucua

SEQ ID NO: 5827 - RNA, 23 nt, artificial
  Completely synthesized
gaagaaaccucauugucaucuac

SEQ ID NO: 5828 - RNA, 23 nt, artificial
  Completely synthesized
cuagcucagaaaaggucaaaucc

SEQ ID NO: 5829 - RNA, 23 nt, artificial
  Completely synthesized
uagcucagaaaaggucaaauccu

SEQ ID NO: 5830 - RNA, 23 nt, artificial
  Completely synthesized
agcucagaaaaggucaaauccuc

SEQ ID NO: 5831 - RNA, 23 nt, artificial
  Completely synthesized
ccaguuuucuuuuucugcaauuc

SEQ ID NO: 5832 - RNA, 23 nt, artificial
  Completely synthesized
agaauguacugguguuuuaggac

SEQ ID NO: 5833 - RNA, 23 nt, artificial
  Completely synthesized
gaauguacugguguuuuaggacc

SEQ ID NO: 5834 - RNA, 23 nt, artificial
  Completely synthesized
aauguacugguguuuuaggacca

SEQ ID NO: 5835 - RNA, 23 nt, artificial
  Completely synthesized
auguacugguguuuuaggaccau

SEQ ID NO: 5836 - RNA, 23 nt, artificial
  Completely synthesized
uguacugguguuuuaggaccauu

SEQ ID NO: 5837 - RNA, 23 nt, artificial
  Completely synthesized
ugcuguugcugauacugggcuca

SEQ ID NO: 5838 - RNA, 23 nt, artificial
  Completely synthesized
aggaauccucaaaagcauuaaga

SEQ ID NO: 5839 - RNA, 23 nt, artificial
  Completely synthesized
ggaauccucaaaagcauuaagaa

SEQ ID NO: 5840 - RNA, 23 nt, artificial
  Completely synthesized
gaauccucaaaagcauuaagaaa

SEQ ID NO: 5841 - RNA, 23 nt, artificial
  Completely synthesized
aauccucaaaagcauuaagaaaa

SEQ ID NO: 5842 - RNA, 23 nt, artificial
  Completely synthesized
auccucaaaagcauuaagaaaau

SEQ ID NO: 5843 - RNA, 23 nt, artificial
  Completely synthesized
uuccauugaggguauagaugagu

SEQ ID NO: 5844 - RNA, 23 nt, artificial
  Completely synthesized
caacuucugucaguuuggcuucu

SEQ ID NO: 5845 - RNA, 23 nt, artificial
  Completely synthesized
aagaucuauaucuugccuccaaa

SEQ ID NO: 5846 - RNA, 23 nt, artificial
  Completely synthesized
agaucuauaucuugccuccaaag

SEQ ID NO: 5847 - RNA, 23 nt, artificial
  Completely synthesized
cagaaguuucaggugacugagcc

SEQ ID NO: 5848 - RNA, 23 nt, artificial
  Completely synthesized
agaaguuucaggugacugagccu

SEQ ID NO: 5849 - RNA, 23 nt, artificial
  Completely synthesized
agucaucaaaguacaaagcaucu

SEQ ID NO: 5850 - RNA, 23 nt, artificial
  Completely synthesized
aauaauccuuuauuaguaccagc

SEQ ID NO: 5851 - RNA, 23 nt, artificial
  Completely synthesized
uuagccagaugucauaucaucau

SEQ ID NO: 5852 - RNA, 23 nt, artificial
  Completely synthesized
uuguaguauuuacacuuacacag

SEQ ID NO: 5853 - RNA, 23 nt, artificial
  Completely synthesized
uguaguauuuacacuuacacaga

SEQ ID NO: 5854 - RNA, 23 nt, artificial
  Completely synthesized
guaguauuuacacuuacacagaa

SEQ ID NO: 5855 - RNA, 23 nt, artificial
  Completely synthesized
uaguauuuacacuuacacagaaa

SEQ ID NO: 5856 - RNA, 23 nt, artificial
  Completely synthesized
uacacagaaacuagcccaaaugg

SEQ ID NO: 5857 - RNA, 23 nt, artificial
  Completely synthesized
acacagaaacuagcccaaauggu

SEQ ID NO: 5858 - RNA, 23 nt, artificial
  Completely synthesized
cacagaaacuagcccaaauggug

SEQ ID NO: 5859 - RNA, 23 nt, artificial
  Completely synthesized
acagaaacuagcccaaauggugu

SEQ ID NO: 5860 - RNA, 23 nt, artificial
  Completely synthesized
caacauacugacacuccaaugcu

SEQ ID NO: 5861 - RNA, 23 nt, artificial
  Completely synthesized
aacauacugacacuccaaugcuu

SEQ ID NO: 5862 - RNA, 23 nt, artificial
  Completely synthesized
acauacugacacuccaaugcuuu

SEQ ID NO: 5863 - RNA, 23 nt, artificial
  Completely synthesized
caaauccuccuaaaucuaguuuu

SEQ ID NO: 5864 - RNA, 23 nt, artificial
  Completely synthesized
aaauccuccuaaaucuaguuuuu

SEQ ID NO: 5865 - RNA, 23 nt, artificial
  Completely synthesized
aauccuccuaaaucuaguuuuuc

SEQ ID NO: 5866 - RNA, 23 nt, artificial
  Completely synthesized
auccuccuaaaucuaguuuuucu

SEQ ID NO: 5867 - RNA, 23 nt, artificial
  Completely synthesized
uccuccuaaaucuaguuuuucuu

SEQ ID NO: 5868 - RNA, 23 nt, artificial
  Completely synthesized
uaacaucuggcuucuuacuuuug

SEQ ID NO: 5869 - RNA, 23 nt, artificial
  Completely synthesized
auaucccgaauuaaugcaaguug

SEQ ID NO: 5870 - RNA, 23 nt, artificial
  Completely synthesized
uaucccgaauuaaugcaaguuga

SEQ ID NO: 5871 - RNA, 23 nt, artificial
  Completely synthesized
ggaaugggauauggagagcuuuu

SEQ ID NO: 5872 - RNA, 23 nt, artificial
  Completely synthesized
gaaugggauauggagagcuuuug

SEQ ID NO: 5873 - RNA, 23 nt, artificial
  Completely synthesized
aaugggauauggagagcuuuugc

SEQ ID NO: 5874 - RNA, 23 nt, artificial
  Completely synthesized
augggauauggagagcuuuugcc

SEQ ID NO: 5875 - RNA, 23 nt, artificial
  Completely synthesized
cuccauagcuggaagauuccacu

SEQ ID NO: 5876 - RNA, 23 nt, artificial
  Completely synthesized
uccauagcuggaagauuccacug

SEQ ID NO: 5877 - RNA, 23 nt, artificial
  Completely synthesized
ccauagcuggaagauuccacuga

SEQ ID NO: 5878 - RNA, 23 nt, artificial
  Completely synthesized
cauagcuggaagauuccacugag

SEQ ID NO: 5879 - RNA, 23 nt, artificial
  Completely synthesized
auagcuggaagauuccacugagu

SEQ ID NO: 5880 - RNA, 23 nt, artificial
  Completely synthesized
uagcuggaagauuccacugagug

SEQ ID NO: 5881 - RNA, 23 nt, artificial
  Completely synthesized
agcuggaagauuccacugagugu

SEQ ID NO: 5882 - RNA, 23 nt, artificial
  Completely synthesized
gcuggaagauuccacugaguguu

SEQ ID NO: 5883 - RNA, 23 nt, artificial
  Completely synthesized
cuggaagauuccacugaguguuc

SEQ ID NO: 5884 - RNA, 23 nt, artificial
  Completely synthesized
uggaagauuccacugaguguucu

SEQ ID NO: 5885 - RNA, 23 nt, artificial
  Completely synthesized
aaugccggagucagaaucauuga

SEQ ID NO: 5886 - RNA, 23 nt, artificial
  Completely synthesized
augccggagucagaaucauugaa

SEQ ID NO: 5887 - RNA, 23 nt, artificial
  Completely synthesized
ugccggagucagaaucauugaau

SEQ ID NO: 5888 - RNA, 23 nt, artificial
  Completely synthesized
gccggagucagaaucauugaauu

SEQ ID NO: 5889 - RNA, 23 nt, artificial
  Completely synthesized
aaacaucaaugggcccauuuaga

SEQ ID NO: 5890 - RNA, 23 nt, artificial
  Completely synthesized
aacaucaaugggcccauuuagaa

SEQ ID NO: 5891 - RNA, 23 nt, artificial
  Completely synthesized
acaucaaugggcccauuuagaag

SEQ ID NO: 5892 - RNA, 23 nt, artificial
  Completely synthesized
caucaaugggcccauuuagaagu

SEQ ID NO: 5893 - RNA, 23 nt, artificial
  Completely synthesized
aucaaugggcccauuuagaaguu

SEQ ID NO: 5894 - RNA, 23 nt, artificial
  Completely synthesized
ucaucaccaaaaucuguguugac

SEQ ID NO: 5895 - RNA, 23 nt, artificial
  Completely synthesized
caucaccaaaaucuguguugacu

SEQ ID NO: 5896 - RNA, 23 nt, artificial
  Completely synthesized
aucaccaaaaucuguguugacug

SEQ ID NO: 5897 - RNA, 23 nt, artificial
  Completely synthesized
ccaagaucuauaucuugccucca

SEQ ID NO: 5898 - RNA, 23 nt, artificial
  Completely synthesized
caagaucuauaucuugccuccaa

SEQ ID NO: 5899 - RNA, 23 nt, artificial
  Completely synthesized
uucaggugacugagccugauuag

SEQ ID NO: 5900 - RNA, 23 nt, artificial
  Completely synthesized
gagccugauuaguagcaaugaag

SEQ ID NO: 5901 - RNA, 23 nt, artificial
  Completely synthesized
agccugauuaguagcaaugaaga

SEQ ID NO: 5902 - RNA, 23 nt, artificial
  Completely synthesized
gccugauuaguagcaaugaagac

SEQ ID NO: 5903 - RNA, 23 nt, artificial
  Completely synthesized
uggcugaauugggagaaauucac

SEQ ID NO: 5904 - RNA, 23 nt, artificial
  Completely synthesized
ggcugaauugggagaaauucacc

SEQ ID NO: 5905 - RNA, 23 nt, artificial
  Completely synthesized
gugaaacuacugauucaacauac

SEQ ID NO: 5906 - RNA, 23 nt, artificial
  Completely synthesized
ugaaacuacugauucaacauacu

SEQ ID NO: 5907 - RNA, 23 nt, artificial
  Completely synthesized
gaaacuacugauucaacauacug

SEQ ID NO: 5908 - RNA, 23 nt, artificial
  Completely synthesized
auacugacacuccaaugcuuuuu

SEQ ID NO: 5909 - RNA, 23 nt, artificial
  Completely synthesized
uacugacacuccaaugcuuuuua

SEQ ID NO: 5910 - RNA, 23 nt, artificial
  Completely synthesized
acugacacuccaaugcuuuuuaa

SEQ ID NO: 5911 - RNA, 23 nt, artificial
  Completely synthesized
cugacacuccaaugcuuuuuaaa

SEQ ID NO: 5912 - RNA, 23 nt, artificial
  Completely synthesized
uacuuuugggaacaaggaaaaca

SEQ ID NO: 5913 - RNA, 23 nt, artificial
  Completely synthesized
acuuuugggaacaaggaaaacau

SEQ ID NO: 5914 - RNA, 23 nt, artificial
  Completely synthesized
cuuuugggaacaaggaaaacauu

SEQ ID NO: 5915 - RNA, 23 nt, artificial
  Completely synthesized
uuuugggaacaaggaaaacauug

SEQ ID NO: 5916 - RNA, 23 nt, artificial
  Completely synthesized
uuugggaacaaggaaaacauugc

SEQ ID NO: 5917 - RNA, 23 nt, artificial
  Completely synthesized
gccaucucuuguuugcugcaggg

SEQ ID NO: 5918 - RNA, 23 nt, artificial
  Completely synthesized
ccaucucuuguuugcugcaggga

SEQ ID NO: 5919 - RNA, 23 nt, artificial
  Completely synthesized
uaagguuuuccaucuucaucacg

SEQ ID NO: 5920 - RNA, 23 nt, artificial
  Completely synthesized
aaucuguguugacuguggcaucu

SEQ ID NO: 5921 - RNA, 23 nt, artificial
  Completely synthesized
ucuaguuguaacugagcgaaaaa

SEQ ID NO: 5922 - RNA, 23 nt, artificial
  Completely synthesized
cuaguuguaacugagcgaaaaag

SEQ ID NO: 5923 - RNA, 23 nt, artificial
  Completely synthesized
uucucuugcuccuuuuggaguug

SEQ ID NO: 5924 - RNA, 23 nt, artificial
  Completely synthesized
caaaaaaacuagcucagaaaagg

SEQ ID NO: 5925 - RNA, 23 nt, artificial
  Completely synthesized
aaaaaaacuagcucagaaaaggu

SEQ ID NO: 5926 - RNA, 23 nt, artificial
  Completely synthesized
aaaaaacuagcucagaaaagguc

SEQ ID NO: 5927 - RNA, 23 nt, artificial
  Completely synthesized
aaaaacuagcucagaaaagguca

SEQ ID NO: 5928 - RNA, 23 nt, artificial
  Completely synthesized
aaaacuagcucagaaaaggucaa

SEQ ID NO: 5929 - RNA, 23 nt, artificial
  Completely synthesized
gaacaaggaaaacauugccaucu

SEQ ID NO: 5930 - RNA, 23 nt, artificial
  Completely synthesized
aacaaggaaaacauugccaucuc

SEQ ID NO: 5931 - RNA, 23 nt, artificial
  Completely synthesized
acaaggaaaacauugccaucucu

SEQ ID NO: 5932 - RNA, 23 nt, artificial
  Completely synthesized
caaggaaaacauugccaucucuu

SEQ ID NO: 5933 - RNA, 23 nt, artificial
  Completely synthesized
gagauauaaggugcugaguuguu

SEQ ID NO: 5934 - RNA, 23 nt, artificial
  Completely synthesized
agauauaaggugcugaguuguuu

SEQ ID NO: 5935 - RNA, 23 nt, artificial
  Completely synthesized
ugcccuaaguucaucucuuguga

SEQ ID NO: 5936 - RNA, 23 nt, artificial
  Completely synthesized
uccaagcggcuugaauguuuguc

SEQ ID NO: 5937 - RNA, 23 nt, artificial
  Completely synthesized
ccaagcggcuugaauguuugucu

SEQ ID NO: 5938 - RNA, 23 nt, artificial
  Completely synthesized
caagcggcuugaauguuugucuu

SEQ ID NO: 5939 - RNA, 23 nt, artificial
  Completely synthesized
aagcggcuugaauguuugucuuu

SEQ ID NO: 5940 - RNA, 23 nt, artificial
  Completely synthesized
agcggcuugaauguuugucuuuu

SEQ ID NO: 5941 - RNA, 23 nt, artificial
  Completely synthesized
ccagcucauacucuuuccgucgc

SEQ ID NO: 5942 - RNA, 23 nt, artificial
  Completely synthesized
cagcucauacucuuuccgucgcu

SEQ ID NO: 5943 - RNA, 23 nt, artificial
  Completely synthesized
agcucauacucuuuccgucgcug

SEQ ID NO: 5944 - RNA, 23 nt, artificial
  Completely synthesized
ucucugguguguucucacauugg

SEQ ID NO: 5945 - RNA, 23 nt, artificial
  Completely synthesized
cucugguguguucucacauuggg

SEQ ID NO: 5946 - RNA, 23 nt, artificial
  Completely synthesized
ucugguguguucucacauugggc

SEQ ID NO: 5947 - RNA, 23 nt, artificial
  Completely synthesized
cugguguguucucacauugggca

SEQ ID NO: 5948 - RNA, 23 nt, artificial
  Completely synthesized
ugguguguucucacauugggcau

SEQ ID NO: 5949 - RNA, 23 nt, artificial
  Completely synthesized
ggaccauucuguuugacacuucc

SEQ ID NO: 5950 - RNA, 23 nt, artificial
  Completely synthesized
agagagugaauggcuuaaaguag

SEQ ID NO: 5951 - RNA, 23 nt, artificial
  Completely synthesized
gagagugaauggcuuaaaguagc

SEQ ID NO: 5952 - RNA, 23 nt, artificial
  Completely synthesized
agagugaauggcuuaaaguagca

SEQ ID NO: 5953 - RNA, 23 nt, artificial
  Completely synthesized
gagugaauggcuuaaaguagcag

SEQ ID NO: 5954 - RNA, 23 nt, artificial
  Completely synthesized
gcuguugcugauacugggcucag

SEQ ID NO: 5955 - RNA, 23 nt, artificial
  Completely synthesized
cuguugcugauacugggcucagc

SEQ ID NO: 5956 - RNA, 23 nt, artificial
  Completely synthesized
uguugcugauacugggcucagcu

SEQ ID NO: 5957 - RNA, 23 nt, artificial
  Completely synthesized
aauugucaacuucugucaguuug

SEQ ID NO: 5958 - RNA, 23 nt, artificial
  Completely synthesized
gcuccucccaaacuugcucaaug

SEQ ID NO: 5959 - RNA, 23 nt, artificial
  Completely synthesized
cuccucccaaacuugcucaaugu

SEQ ID NO: 5960 - RNA, 23 nt, artificial
  Completely synthesized
uccucccaaacuugcucaauguc

SEQ ID NO: 5961 - RNA, 23 nt, artificial
  Completely synthesized
aguuaaagugaaacuacugauuc

SEQ ID NO: 5962 - RNA, 23 nt, artificial
  Completely synthesized
guuaaagugaaacuacugauuca

SEQ ID NO: 5963 - RNA, 23 nt, artificial
  Completely synthesized
uuaaagugaaacuacugauucaa

SEQ ID NO: 5964 - RNA, 23 nt, artificial
  Completely synthesized
uaaagugaaacuacugauucaac

SEQ ID NO: 5965 - RNA, 23 nt, artificial
  Completely synthesized
aaagugaaacuacugauucaaca

SEQ ID NO: 5966 - RNA, 23 nt, artificial
  Completely synthesized
cauacugacacuccaaugcuuuu

SEQ ID NO: 5967 - RNA, 23 nt, artificial
  Completely synthesized
aaacuagcucagaaaaggucaaa

SEQ ID NO: 5968 - RNA, 23 nt, artificial
  Completely synthesized
aacuagcucagaaaaggucaaau

SEQ ID NO: 5969 - RNA, 23 nt, artificial
  Completely synthesized
acuagcucagaaaaggucaaauc

SEQ ID NO: 5970 - RNA, 23 nt, artificial
  Completely synthesized
cgagauauaaggugcugaguugu

SEQ ID NO: 5971 - RNA, 23 nt, artificial
  Completely synthesized
uucaguaggugaaggcuuuuguc

SEQ ID NO: 5972 - RNA, 23 nt, artificial
  Completely synthesized
ucaguaggugaaggcuuuuguca

SEQ ID NO: 5973 - RNA, 23 nt, artificial
  Completely synthesized
caguaggugaaggcuuuugucau

SEQ ID NO: 5974 - RNA, 23 nt, artificial
  Completely synthesized
aguaggugaaggcuuuugucauu

SEQ ID NO: 5975 - RNA, 23 nt, artificial
  Completely synthesized
ucauuuucuccuuuuucuuugag

SEQ ID NO: 5976 - RNA, 23 nt, artificial
  Completely synthesized
cuuucaaaugaucuaaaucuugc

SEQ ID NO: 5977 - RNA, 23 nt, artificial
  Completely synthesized
uuucaaaugaucuaaaucuugcu

SEQ ID NO: 5978 - RNA, 23 nt, artificial
  Completely synthesized
cugcaauucugagcagccacuuu

SEQ ID NO: 5979 - RNA, 23 nt, artificial
  Completely synthesized
agcucuuccacuucagaaucacu

SEQ ID NO: 5980 - RNA, 23 nt, artificial
  Completely synthesized
uagugaaaugccggagucagaau

SEQ ID NO: 5981 - RNA, 23 nt, artificial
  Completely synthesized
ccaaguccaucaugaugagcugu

SEQ ID NO: 5982 - RNA, 23 nt, artificial
  Completely synthesized
ggagucagaaucauugaauucug

SEQ ID NO: 5983 - RNA, 23 nt, artificial
  Completely synthesized
gagucagaaucauugaauucugc

SEQ ID NO: 5984 - RNA, 23 nt, artificial
  Completely synthesized
agucagaaucauugaauucugcu

SEQ ID NO: 5985 - RNA, 23 nt, artificial
  Completely synthesized
gucagaaucauugaauucugcug

SEQ ID NO: 5986 - RNA, 23 nt, artificial
  Completely synthesized
ugcaaagugauagaucagaaaca

SEQ ID NO: 5987 - RNA, 23 nt, artificial
  Completely synthesized
gcaaagugauagaucagaaacau

SEQ ID NO: 5988 - RNA, 23 nt, artificial
  Completely synthesized
caaagugauagaucagaaacauc

SEQ ID NO: 5989 - RNA, 23 nt, artificial
  Completely synthesized
uagaaguucagagagugaauggc

SEQ ID NO: 5990 - RNA, 23 nt, artificial
  Completely synthesized
guugcugauacugggcucagcua

SEQ ID NO: 5991 - RNA, 23 nt, artificial
  Completely synthesized
uugcugauacugggcucagcuau

SEQ ID NO: 5992 - RNA, 23 nt, artificial
  Completely synthesized
acuguggcaucugaauuuaauga

SEQ ID NO: 5993 - RNA, 23 nt, artificial
  Completely synthesized
cuguggcaucugaauuuaaugag

SEQ ID NO: 5994 - RNA, 23 nt, artificial
  Completely synthesized
uguggcaucugaauuuaaugagu

SEQ ID NO: 5995 - RNA, 23 nt, artificial
  Completely synthesized
guggcaucugaauuuaaugaguu

SEQ ID NO: 5996 - RNA, 23 nt, artificial
  Completely synthesized
uggcaucugaauuuaaugaguuc

SEQ ID NO: 5997 - RNA, 23 nt, artificial
  Completely synthesized
agcauuaagaaaauguggacuac

SEQ ID NO: 5998 - RNA, 23 nt, artificial
  Completely synthesized
uaccugagcaacagaaguuucag

SEQ ID NO: 5999 - RNA, 23 nt, artificial
  Completely synthesized
accugagcaacagaaguuucagg

SEQ ID NO: 6000 - RNA, 23 nt, artificial
  Completely synthesized
ccugagcaacagaaguuucaggu

SEQ ID NO: 6001 - RNA, 23 nt, artificial
  Completely synthesized
cugagcaacagaaguuucaggug

SEQ ID NO: 6002 - RNA, 23 nt, artificial
  Completely synthesized
ugagcaacagaaguuucagguga

SEQ ID NO: 6003 - RNA, 23 nt, artificial
  Completely synthesized
acugagccugauuaguagcaaug

SEQ ID NO: 6004 - RNA, 23 nt, artificial
  Completely synthesized
cugagccugauuaguagcaauga

SEQ ID NO: 6005 - RNA, 23 nt, artificial
  Completely synthesized
ugagccugauuaguagcaaugaa

SEQ ID NO: 6006 - RNA, 23 nt, artificial
  Completely synthesized
uaguagcaaugaagacugggcuc

SEQ ID NO: 6007 - RNA, 23 nt, artificial
  Completely synthesized
aguagcaaugaagacugggcucu

SEQ ID NO: 6008 - RNA, 23 nt, artificial
  Completely synthesized
guagcaaugaagacugggcucuc

SEQ ID NO: 6009 - RNA, 23 nt, artificial
  Completely synthesized
auaucaggaacaagugacugaaa

SEQ ID NO: 6010 - RNA, 23 nt, artificial
  Completely synthesized
uaucaggaacaagugacugaaac

SEQ ID NO: 6011 - RNA, 23 nt, artificial
  Completely synthesized
aggaacaagugacugaaacguag

SEQ ID NO: 6012 - RNA, 23 nt, artificial
  Completely synthesized
ggaacaagugacugaaacguagc

SEQ ID NO: 6013 - RNA, 23 nt, artificial
  Completely synthesized
gaacaagugacugaaacguagcc

SEQ ID NO: 6014 - RNA, 23 nt, artificial
  Completely synthesized
ucaaauccauguccugcugggac

SEQ ID NO: 6015 - RNA, 23 nt, artificial
  Completely synthesized
auaaaaaaugccauuuuuugucc

SEQ ID NO: 6016 - RNA, 23 nt, artificial
  Completely synthesized
uaaaaaaugccauuuuuugucca

SEQ ID NO: 6017 - RNA, 23 nt, artificial
  Completely synthesized
aaaaaaugccauuuuuuguccau

SEQ ID NO: 6018 - RNA, 23 nt, artificial
  Completely synthesized
aaaaaugccauuuuuuguccaua

SEQ ID NO: 6019 - RNA, 23 nt, artificial
  Completely synthesized
ucucuugcuccuuuuggaguugu

SEQ ID NO: 6020 - RNA, 23 nt, artificial
  Completely synthesized
uuacuuuugggaacaaggaaaac

SEQ ID NO: 6021 - RNA, 23 nt, artificial
  Completely synthesized
guaggugaaggcuuuugucauuu

SEQ ID NO: 6022 - RNA, 23 nt, artificial
  Completely synthesized
uaggugaaggcuuuugucauuuu

SEQ ID NO: 6023 - RNA, 23 nt, artificial
  Completely synthesized
aggugaaggcuuuugucauuuuc

SEQ ID NO: 6024 - RNA, 23 nt, artificial
  Completely synthesized
uaaguucaucucuugugagauga

SEQ ID NO: 6025 - RNA, 23 nt, artificial
  Completely synthesized
aaguucaucucuugugagaugag

SEQ ID NO: 6026 - RNA, 23 nt, artificial
  Completely synthesized
aguucaucucuugugagaugagc

SEQ ID NO: 6027 - RNA, 23 nt, artificial
  Completely synthesized
cagaaucacugaggccaaguagu

SEQ ID NO: 6028 - RNA, 23 nt, artificial
  Completely synthesized
agaaucacugaggccaaguagug

SEQ ID NO: 6029 - RNA, 23 nt, artificial
  Completely synthesized
gaaucacugaggccaaguagugu

SEQ ID NO: 6030 - RNA, 23 nt, artificial
  Completely synthesized
aaucacugaggccaaguagugug

SEQ ID NO: 6031 - RNA, 23 nt, artificial
  Completely synthesized
aucacugaggccaaguagugugu

SEQ ID NO: 6032 - RNA, 23 nt, artificial
  Completely synthesized
gcugacugaagucaaauacuucu

SEQ ID NO: 6033 - RNA, 23 nt, artificial
  Completely synthesized
cugacugaagucaaauacuucuc

SEQ ID NO: 6034 - RNA, 23 nt, artificial
  Completely synthesized
gacuguggcaucugaauuuaaug

SEQ ID NO: 6035 - RNA, 23 nt, artificial
  Completely synthesized
cugcugaaggaauccucaaaagc

SEQ ID NO: 6036 - RNA, 23 nt, artificial
  Completely synthesized
ugcugaaggaauccucaaaagca

SEQ ID NO: 6037 - RNA, 23 nt, artificial
  Completely synthesized
gcugaaggaauccucaaaagcau

SEQ ID NO: 6038 - RNA, 23 nt, artificial
  Completely synthesized
cugaaggaauccucaaaagcauu

SEQ ID NO: 6039 - RNA, 23 nt, artificial
  Completely synthesized
ugaaggaauccucaaaagcauua

SEQ ID NO: 6040 - RNA, 23 nt, artificial
  Completely synthesized
aagaaaauguggacuacaguuac

SEQ ID NO: 6041 - RNA, 23 nt, artificial
  Completely synthesized
ugcucaauguccuguugcauacc

SEQ ID NO: 6042 - RNA, 23 nt, artificial
  Completely synthesized
gcucaauguccuguugcauaccg

SEQ ID NO: 6043 - RNA, 23 nt, artificial
  Completely synthesized
cucaauguccuguugcauaccgu

SEQ ID NO: 6044 - RNA, 23 nt, artificial
  Completely synthesized
cucgaugugaccgggaauaucag

SEQ ID NO: 6045 - RNA, 23 nt, artificial
  Completely synthesized
uccacugguuucugacuggaugu

SEQ ID NO: 6046 - RNA, 23 nt, artificial
  Completely synthesized
ccacugguuucugacuggaugug

SEQ ID NO: 6047 - RNA, 23 nt, artificial
  Completely synthesized
cacugguuucugacuggaugugc

SEQ ID NO: 6048 - RNA, 23 nt, artificial
  Completely synthesized
acugguuucugacuggaugugcu

SEQ ID NO: 6049 - RNA, 23 nt, artificial
  Completely synthesized
uaauaguacaaaaaaacuagcuc

SEQ ID NO: 6050 - RNA, 23 nt, artificial
  Completely synthesized
aauaguacaaaaaaacuagcuca

SEQ ID NO: 6051 - RNA, 23 nt, artificial
  Completely synthesized
ucaucacguagcaugcugaaaac

SEQ ID NO: 6052 - RNA, 23 nt, artificial
  Completely synthesized
caucacguagcaugcugaaaacu

SEQ ID NO: 6053 - RNA, 23 nt, artificial
  Completely synthesized
aucacguagcaugcugaaaacuu

SEQ ID NO: 6054 - RNA, 23 nt, artificial
  Completely synthesized
ucacguagcaugcugaaaacuuc

SEQ ID NO: 6055 - RNA, 23 nt, artificial
  Completely synthesized
gcagcuccaaguccaucaugaug

SEQ ID NO: 6056 - RNA, 23 nt, artificial
  Completely synthesized
gaccaggacuuacaggcaauucu

SEQ ID NO: 6057 - RNA, 23 nt, artificial
  Completely synthesized
accaggacuuacaggcaauucuu

SEQ ID NO: 6058 - RNA, 23 nt, artificial
  Completely synthesized
ccaggacuuacaggcaauucuuu

SEQ ID NO: 6059 - RNA, 23 nt, artificial
  Completely synthesized
ugagauggugacaaggguuguac

SEQ ID NO: 6060 - RNA, 23 nt, artificial
  Completely synthesized
gagauggugacaaggguuguacc

SEQ ID NO: 6061 - RNA, 23 nt, artificial
  Completely synthesized
agauggugacaaggguuguacca

SEQ ID NO: 6062 - RNA, 23 nt, artificial
  Completely synthesized
gauggugacaaggguuguaccau

SEQ ID NO: 6063 - RNA, 23 nt, artificial
  Completely synthesized
auggugacaaggguuguaccaua

SEQ ID NO: 6064 - RNA, 23 nt, artificial
  Completely synthesized
ucugcugugcuuucagggugguu

SEQ ID NO: 6065 - RNA, 23 nt, artificial
  Completely synthesized
gaaguucagagagugaauggcuu

SEQ ID NO: 6066 - RNA, 23 nt, artificial
  Completely synthesized
aaguucagagagugaauggcuua

SEQ ID NO: 6067 - RNA, 23 nt, artificial
  Completely synthesized
aguucagagagugaauggcuuaa

SEQ ID NO: 6068 - RNA, 23 nt, artificial
  Completely synthesized
guucagagagugaauggcuuaaa

SEQ ID NO: 6069 - RNA, 23 nt, artificial
  Completely synthesized
uucagagagugaauggcuuaaag

SEQ ID NO: 6070 - RNA, 23 nt, artificial
  Completely synthesized
ugcugauacugggcucagcuaug

SEQ ID NO: 6071 - RNA, 23 nt, artificial
  Completely synthesized
gcugauacugggcucagcuauga

SEQ ID NO: 6072 - RNA, 23 nt, artificial
  Completely synthesized
cugauacugggcucagcuaugaa

SEQ ID NO: 6073 - RNA, 23 nt, artificial
  Completely synthesized
ugauacugggcucagcuaugaaa

SEQ ID NO: 6074 - RNA, 23 nt, artificial
  Completely synthesized
ucaccaaaaucuguguugacugu

SEQ ID NO: 6075 - RNA, 23 nt, artificial
  Completely synthesized
aucuguguugacuguggcaucug

SEQ ID NO: 6076 - RNA, 23 nt, artificial
  Completely synthesized
ucuguguugacuguggcaucuga

SEQ ID NO: 6077 - RNA, 23 nt, artificial
  Completely synthesized
ugguagucucaaccagcuuguca

SEQ ID NO: 6078 - RNA, 23 nt, artificial
  Completely synthesized
gguagucucaaccagcuugucau

SEQ ID NO: 6079 - RNA, 23 nt, artificial
  Completely synthesized
guagucucaaccagcuugucauu

SEQ ID NO: 6080 - RNA, 23 nt, artificial
  Completely synthesized
uagucucaaccagcuugucauuu

SEQ ID NO: 6081 - RNA, 23 nt, artificial
  Completely synthesized
agucucaaccagcuugucauuuu

SEQ ID NO: 6082 - RNA, 23 nt, artificial
  Completely synthesized
caaacuugcucaauguccuguug

SEQ ID NO: 6083 - RNA, 23 nt, artificial
  Completely synthesized
ugaagacugggcucucgauguga

SEQ ID NO: 6084 - RNA, 23 nt, artificial
  Completely synthesized
gaagacugggcucucgaugugac

SEQ ID NO: 6085 - RNA, 23 nt, artificial
  Completely synthesized
aagacugggcucucgaugugacc

SEQ ID NO: 6086 - RNA, 23 nt, artificial
  Completely synthesized
cagucaucaaaguacaaagcauc

SEQ ID NO: 6087 - RNA, 23 nt, artificial
  Completely synthesized
uuaguaccagcucuuaaaauuuu

SEQ ID NO: 6088 - RNA, 19 nt, artificial
  Completely synthesized
gaaaaaacuugaaaaggaa

SEQ ID NO: 6089 - RNA, 19 nt, artificial
  Completely synthesized
gaaagaugaaaaagaaaaa

SEQ ID NO: 6090 - RNA, 19 nt, artificial
  Completely synthesized
ccaaaacuaguauagaaaa

SEQ ID NO: 6091 - RNA, 19 nt, artificial
  Completely synthesized
agauuuagaucauuugaaa

SEQ ID NO: 6092 - RNA, 19 nt, artificial
  Completely synthesized
aaguguaaauacuacaaaa

SEQ ID NO: 6093 - RNA, 19 nt, artificial
  Completely synthesized
gaaaaauugcucaaagaaa

SEQ ID NO: 6094 - RNA, 19 nt, artificial
  Completely synthesized
gaaaaagaaaacuggaaaa

SEQ ID NO: 6095 - RNA, 19 nt, artificial
  Completely synthesized
aaaaauugcucaaagaaaa

SEQ ID NO: 6096 - RNA, 19 nt, artificial
  Completely synthesized
gaaauuauugcaaaacuaa

SEQ ID NO: 6097 - RNA, 19 nt, artificial
  Completely synthesized
gcaaagcuuucaaccaaaa

SEQ ID NO: 6098 - RNA, 19 nt, artificial
  Completely synthesized
acuggaaaauauaguagaa

SEQ ID NO: 6099 - RNA, 19 nt, artificial
  Completely synthesized
ggaaaauauaguagaacua

SEQ ID NO: 6100 - RNA, 19 nt, artificial
  Completely synthesized
caaugaagcucaacuugca

SEQ ID NO: 6101 - RNA, 19 nt, artificial
  Completely synthesized
ggaaaaacagaaaaaacuu

SEQ ID NO: 6102 - RNA, 19 nt, artificial
  Completely synthesized
agaauugcagaaaaagaaa

SEQ ID NO: 6103 - RNA, 19 nt, artificial
  Completely synthesized
aauacuguauggacaaaaa

SEQ ID NO: 6104 - RNA, 19 nt, artificial
  Completely synthesized
caaagaaaaaggagaaaau

SEQ ID NO: 6105 - RNA, 19 nt, artificial
  Completely synthesized
agaacuagagcaagauuua

SEQ ID NO: 6106 - RNA, 19 nt, artificial
  Completely synthesized
aagaaaacuggaaaauaua

SEQ ID NO: 6107 - RNA, 19 nt, artificial
  Completely synthesized
agaaauuauugcaaaacua

SEQ ID NO: 6108 - RNA, 19 nt, artificial
  Completely synthesized
cuguagaaaaaaucauuaa

SEQ ID NO: 6109 - RNA, 19 nt, artificial
  Completely synthesized
caaaaaauggcauuuuuua

SEQ ID NO: 6110 - RNA, 19 nt, artificial
  Completely synthesized
aaaugcucauacuuuauaa

SEQ ID NO: 6111 - RNA, 19 nt, artificial
  Completely synthesized
cagugucuuaauauugaaa

SEQ ID NO: 6112 - RNA, 19 nt, artificial
  Completely synthesized
acagugucuuaauauugaa

SEQ ID NO: 6113 - RNA, 19 nt, artificial
  Completely synthesized
uuugaaagaugaaaaagaa

SEQ ID NO: 6114 - RNA, 19 nt, artificial
  Completely synthesized
aaagaaaacuggaaaauau

SEQ ID NO: 6115 - RNA, 19 nt, artificial
  Completely synthesized
agaaaaagaaaacuggaaa

SEQ ID NO: 6116 - RNA, 19 nt, artificial
  Completely synthesized
gaauugcagaaaaagaaaa

SEQ ID NO: 6117 - RNA, 19 nt, artificial
  Completely synthesized
gugucuuaauauugaaaau

SEQ ID NO: 6118 - RNA, 19 nt, artificial
  Completely synthesized
ccuguagaaaaaaucauua

SEQ ID NO: 6119 - RNA, 19 nt, artificial
  Completely synthesized
aaaaggagaaaaugacaaa

SEQ ID NO: 6120 - RNA, 19 nt, artificial
  Completely synthesized
aaaauauaguagaacuaga

SEQ ID NO: 6121 - RNA, 19 nt, artificial
  Completely synthesized
gcucauacuuuauaaguaa

SEQ ID NO: 6122 - RNA, 19 nt, artificial
  Completely synthesized
caaaacuaguauagaaaau

SEQ ID NO: 6123 - RNA, 19 nt, artificial
  Completely synthesized
cacuuuaacuguaaacaau

SEQ ID NO: 6124 - RNA, 19 nt, artificial
  Completely synthesized
acaaaagacaaacauucaa

SEQ ID NO: 6125 - RNA, 19 nt, artificial
  Completely synthesized
aaaacagaaaaaacuugaa

SEQ ID NO: 6126 - RNA, 19 nt, artificial
  Completely synthesized
agaaaaaacuugaaaagga

SEQ ID NO: 6127 - RNA, 19 nt, artificial
  Completely synthesized
gaauacucccugcagcaaa

SEQ ID NO: 6128 - RNA, 19 nt, artificial
  Completely synthesized
aacagaaaaaacuugaaaa

SEQ ID NO: 6129 - RNA, 19 nt, artificial
  Completely synthesized
caauuaucauuuuuacuca

SEQ ID NO: 6130 - RNA, 19 nt, artificial
  Completely synthesized
gaaagaauugccuguaagu

SEQ ID NO: 6131 - RNA, 19 nt, artificial
  Completely synthesized
agaaaaauugcucaaagaa

SEQ ID NO: 6132 - RNA, 19 nt, artificial
  Completely synthesized
aaaaaacuugaaaaggaaa

SEQ ID NO: 6133 - RNA, 19 nt, artificial
  Completely synthesized
ugaaagaugaaaaagaaaa

SEQ ID NO: 6134 - RNA, 19 nt, artificial
  Completely synthesized
gauaugacaucuggcuaaa

SEQ ID NO: 6135 - RNA, 19 nt, artificial
  Completely synthesized
auaaguaauucuaugcaaa

SEQ ID NO: 6136 - RNA, 19 nt, artificial
  Completely synthesized
ucauuugaaagaugaaaaa

SEQ ID NO: 6137 - RNA, 19 nt, artificial
  Completely synthesized
uugaaagaugaaaaagaaa

SEQ ID NO: 6138 - RNA, 19 nt, artificial
  Completely synthesized
caagauuuagaucauuuga

SEQ ID NO: 6139 - RNA, 19 nt, artificial
  Completely synthesized
aagaaaaauugcucaaaga

SEQ ID NO: 6140 - RNA, 19 nt, artificial
  Completely synthesized
aaaauugcucaaagaaaaa

SEQ ID NO: 6141 - RNA, 19 nt, artificial
  Completely synthesized
aucaguaguuucacuuuaa

SEQ ID NO: 6142 - RNA, 19 nt, artificial
  Completely synthesized
uaaguaauucuaugcaaaa

SEQ ID NO: 6143 - RNA, 19 nt, artificial
  Completely synthesized
auacuguauggacaaaaaa

SEQ ID NO: 6144 - RNA, 19 nt, artificial
  Completely synthesized
cagcacauccagucagaaa

SEQ ID NO: 6145 - RNA, 19 nt, artificial
  Completely synthesized
gucuuaauauugaaaauga

SEQ ID NO: 6146 - RNA, 19 nt, artificial
  Completely synthesized
aaaggagaaaaugacaaaa

SEQ ID NO: 6147 - RNA, 19 nt, artificial
  Completely synthesized
agauuuuggugaugaauuu

SEQ ID NO: 6148 - RNA, 19 nt, artificial
  Completely synthesized
aaaagaaaacuggaaaaua

SEQ ID NO: 6149 - RNA, 19 nt, artificial
  Completely synthesized
agaucauuugaaagaugaa

SEQ ID NO: 6150 - RNA, 19 nt, artificial
  Completely synthesized
aaacagaaaaaacuugaaa

SEQ ID NO: 6151 - RNA, 19 nt, artificial
  Completely synthesized
cacuauguacuuuuuuaua

SEQ ID NO: 6152 - RNA, 19 nt, artificial
  Completely synthesized
ucuauacccucaauggaaa

SEQ ID NO: 6153 - RNA, 19 nt, artificial
  Completely synthesized
auuuuauucugcuuucaua

SEQ ID NO: 6154 - RNA, 19 nt, artificial
  Completely synthesized
gacaaaaaauggcauuuuu

SEQ ID NO: 6155 - RNA, 19 nt, artificial
  Completely synthesized
ucacuuuaacuguaaacaa

SEQ ID NO: 6156 - RNA, 19 nt, artificial
  Completely synthesized
aagaaaaaggagaaaauga

SEQ ID NO: 6157 - RNA, 19 nt, artificial
  Completely synthesized
cuggcuaaaaagaaauuau

SEQ ID NO: 6158 - RNA, 19 nt, artificial
  Completely synthesized
uuuuggugaugaauuuuau

SEQ ID NO: 6159 - RNA, 19 nt, artificial
  Completely synthesized
cauuuguuauauucauaga

SEQ ID NO: 6160 - RNA, 19 nt, artificial
  Completely synthesized
cauagauuuauaugaugau

SEQ ID NO: 6161 - RNA, 19 nt, artificial
  Completely synthesized
ggaaaaccuuauucuccua

SEQ ID NO: 6162 - RNA, 19 nt, artificial
  Completely synthesized
gaaguggaagagcuagaua

SEQ ID NO: 6163 - RNA, 19 nt, artificial
  Completely synthesized
ccacuauguacuuuuuuau

SEQ ID NO: 6164 - RNA, 19 nt, artificial
  Completely synthesized
gaauuuuauucugcuuuca

SEQ ID NO: 6165 - RNA, 19 nt, artificial
  Completely synthesized
gauguuaagaaaaacuaga

SEQ ID NO: 6166 - RNA, 19 nt, artificial
  Completely synthesized
aagauuuagaucauuugaa

SEQ ID NO: 6167 - RNA, 19 nt, artificial
  Completely synthesized
auaaauacuguauggacaa

SEQ ID NO: 6168 - RNA, 19 nt, artificial
  Completely synthesized
aguguaaauacuacaaaaa

SEQ ID NO: 6169 - RNA, 19 nt, artificial
  Completely synthesized
cuuaauauugaaaaugaca

SEQ ID NO: 6170 - RNA, 19 nt, artificial
  Completely synthesized
ucauuuuuacucaucuaua

SEQ ID NO: 6171 - RNA, 19 nt, artificial
  Completely synthesized
guucuuaugucauuuguua

SEQ ID NO: 6172 - RNA, 19 nt, artificial
  Completely synthesized
ugguacuaauaaaggauua

SEQ ID NO: 6173 - RNA, 19 nt, artificial
  Completely synthesized
guuacagugucuuaauauu

SEQ ID NO: 6174 - RNA, 19 nt, artificial
  Completely synthesized
uacuguauggacaaaaaau

SEQ ID NO: 6175 - RNA, 19 nt, artificial
  Completely synthesized
uauaaauacuguauggaca

SEQ ID NO: 6176 - RNA, 19 nt, artificial
  Completely synthesized
aaaaaggagaaaaugacaa

SEQ ID NO: 6177 - RNA, 19 nt, artificial
  Completely synthesized
gaucauuugaaagaugaaa

SEQ ID NO: 6178 - RNA, 19 nt, artificial
  Completely synthesized
uauaaguaauucuaugcaa

SEQ ID NO: 6179 - RNA, 19 nt, artificial
  Completely synthesized
aacuggaaaauauaguaga

SEQ ID NO: 6180 - RNA, 19 nt, artificial
  Completely synthesized
ggaggcucaucucacaaga

SEQ ID NO: 6181 - RNA, 19 nt, artificial
  Completely synthesized
uggaaaaacagaaaaaacu

SEQ ID NO: 6182 - RNA, 19 nt, artificial
  Completely synthesized
uacagugucuuaauauuga

SEQ ID NO: 6183 - RNA, 19 nt, artificial
  Completely synthesized
cauuuuuacucaucuauac

SEQ ID NO: 6184 - RNA, 19 nt, artificial
  Completely synthesized
gaaaaagaaaaauugcuca

SEQ ID NO: 6185 - RNA, 19 nt, artificial
  Completely synthesized
agugucuuaauauugaaaa

SEQ ID NO: 6186 - RNA, 19 nt, artificial
  Completely synthesized
uggcuaaaaagaaauuauu

SEQ ID NO: 6187 - RNA, 19 nt, artificial
  Completely synthesized
acagugaacucauuaaauu

SEQ ID NO: 6188 - RNA, 19 nt, artificial
  Completely synthesized
uguguaaguguaaauacua

SEQ ID NO: 6189 - RNA, 19 nt, artificial
  Completely synthesized
guuucacuuuaacuguaaa

SEQ ID NO: 6190 - RNA, 19 nt, artificial
  Completely synthesized
aaaacuggaaaauauagua

SEQ ID NO: 6191 - RNA, 19 nt, artificial
  Completely synthesized
accacuauguacuuuuuua

SEQ ID NO: 6192 - RNA, 19 nt, artificial
  Completely synthesized
ugcucauacuuuauaagua

SEQ ID NO: 6193 - RNA, 19 nt, artificial
  Completely synthesized
auuugaaagaugaaaaaga

SEQ ID NO: 6194 - RNA, 19 nt, artificial
  Completely synthesized
agaaaaacuagauuuagga

SEQ ID NO: 6195 - RNA, 19 nt, artificial
  Completely synthesized
gaaaauaauacgaaacuuu

SEQ ID NO: 6196 - RNA, 19 nt, artificial
  Completely synthesized
ugaugaauuuuauucugcu

SEQ ID NO: 6197 - RNA, 19 nt, artificial
  Completely synthesized
uggaaaauauaguagaacu

SEQ ID NO: 6198 - RNA, 19 nt, artificial
  Completely synthesized
acgaaacuuuaaaaagcau

SEQ ID NO: 6199 - RNA, 19 nt, artificial
  Completely synthesized
ugaacucauuaaauucaga

SEQ ID NO: 6200 - RNA, 19 nt, artificial
  Completely synthesized
guucaaugaagcucaacuu

SEQ ID NO: 6201 - RNA, 19 nt, artificial
  Completely synthesized
uaucauuuuuacucaucua

SEQ ID NO: 6202 - RNA, 19 nt, artificial
  Completely synthesized
agaaguugacaauuaucau

SEQ ID NO: 6203 - RNA, 19 nt, artificial
  Completely synthesized
cuaaaaagaaauuauugca

SEQ ID NO: 6204 - RNA, 19 nt, artificial
  Completely synthesized
gucauuuguuauauucaua

SEQ ID NO: 6205 - RNA, 19 nt, artificial
  Completely synthesized
cagauguuaagaaaaacua

SEQ ID NO: 6206 - RNA, 19 nt, artificial
  Completely synthesized
guaaguguaaauacuacaa

SEQ ID NO: 6207 - RNA, 19 nt, artificial
  Completely synthesized
uaaguguaaauacuacaaa

SEQ ID NO: 6208 - RNA, 19 nt, artificial
  Completely synthesized
uaaauacuguauggacaaa

SEQ ID NO: 6209 - RNA, 19 nt, artificial
  Completely synthesized
aaucaguaguuucacuuua

SEQ ID NO: 6210 - RNA, 19 nt, artificial
  Completely synthesized
aaaagaaaaauugcucaaa

SEQ ID NO: 6211 - RNA, 19 nt, artificial
  Completely synthesized
uugcaaagcuuucaaccaa

SEQ ID NO: 6212 - RNA, 19 nt, artificial
  Completely synthesized
ugucauuuguuauauucau

SEQ ID NO: 6213 - RNA, 19 nt, artificial
  Completely synthesized
aguugacaauuaucauuuu

SEQ ID NO: 6214 - RNA, 19 nt, artificial
  Completely synthesized
gaaucaguaguuucacuuu

SEQ ID NO: 6215 - RNA, 19 nt, artificial
  Completely synthesized
gguacuaauaaaggauuau

SEQ ID NO: 6216 - RNA, 19 nt, artificial
  Completely synthesized
gauauagaucuuggaguaa

SEQ ID NO: 6217 - RNA, 19 nt, artificial
  Completely synthesized
acuuauuuauacuguucuu

SEQ ID NO: 6218 - RNA, 19 nt, artificial
  Completely synthesized
gaaaugcucauacuuuaua

SEQ ID NO: 6219 - RNA, 19 nt, artificial
  Completely synthesized
aguaagaagccagauguua

SEQ ID NO: 6220 - RNA, 19 nt, artificial
  Completely synthesized
uaguccacauuuucuuaau

SEQ ID NO: 6221 - RNA, 19 nt, artificial
  Completely synthesized
cgaaacuuuaaaaagcauu

SEQ ID NO: 6222 - RNA, 19 nt, artificial
  Completely synthesized
uuuauaugaugauaugaca

SEQ ID NO: 6223 - RNA, 19 nt, artificial
  Completely synthesized
gauuuauaugaugauauga

SEQ ID NO: 6224 - RNA, 19 nt, artificial
  Completely synthesized
aguuacagugucuuaauau

SEQ ID NO: 6225 - RNA, 19 nt, artificial
  Completely synthesized
aaaaagaaaaauugcucaa

SEQ ID NO: 6226 - RNA, 19 nt, artificial
  Completely synthesized
ucuuaauauugaaaaugac

SEQ ID NO: 6227 - RNA, 19 nt, artificial
  Completely synthesized
guauagaaaauaauacgaa

SEQ ID NO: 6228 - RNA, 19 nt, artificial
  Completely synthesized
aaauacuguauggacaaaa

SEQ ID NO: 6229 - RNA, 19 nt, artificial
  Completely synthesized
gaacuagagcaagauuuag

SEQ ID NO: 6230 - RNA, 19 nt, artificial
  Completely synthesized
ugaaaugcucauacuuuau

SEQ ID NO: 6231 - RNA, 19 nt, artificial
  Completely synthesized
uaaacaauuucuuaggaca

SEQ ID NO: 6232 - RNA, 19 nt, artificial
  Completely synthesized
ugaugaagauggaaaaccu

SEQ ID NO: 6233 - RNA, 19 nt, artificial
  Completely synthesized
gaugaauuuuauucugcuu

SEQ ID NO: 6234 - RNA, 19 nt, artificial
  Completely synthesized
agauguuaagaaaaacuag

SEQ ID NO: 6235 - RNA, 19 nt, artificial
  Completely synthesized
aaaaacagaaaaaacuuga

SEQ ID NO: 6236 - RNA, 19 nt, artificial
  Completely synthesized
agaugaaaaagaaaaauug

SEQ ID NO: 6237 - RNA, 19 nt, artificial
  Completely synthesized
agauuuauaugaugauaug

SEQ ID NO: 6238 - RNA, 19 nt, artificial
  Completely synthesized
gaaaaacagaaaaaacuug

SEQ ID NO: 6239 - RNA, 19 nt, artificial
  Completely synthesized
gauucugacuccggcauuu

SEQ ID NO: 6240 - RNA, 19 nt, artificial
  Completely synthesized
acagauuuuggugaugaau

SEQ ID NO: 6241 - RNA, 19 nt, artificial
  Completely synthesized
uguaaauacuacaaaaacu

SEQ ID NO: 6242 - RNA, 19 nt, artificial
  Completely synthesized
uacgaaacuuuaaaaagca

SEQ ID NO: 6243 - RNA, 19 nt, artificial
  Completely synthesized
acaaaaaauggcauuuuuu

SEQ ID NO: 6244 - RNA, 19 nt, artificial
  Completely synthesized
gaucuaucacuuugcaaag

SEQ ID NO: 6245 - RNA, 19 nt, artificial
  Completely synthesized
aaauuauugcaaaacuaac

SEQ ID NO: 6246 - RNA, 19 nt, artificial
  Completely synthesized
ucaaagaaaaaggagaaaa

SEQ ID NO: 6247 - RNA, 19 nt, artificial
  Completely synthesized
ggcuaaaaagaaauuauug

SEQ ID NO: 6248 - RNA, 19 nt, artificial
  Completely synthesized
aacccuugucaccaucuca

SEQ ID NO: 6249 - RNA, 19 nt, artificial
  Completely synthesized
aauucuaugcaaaaucaua

SEQ ID NO: 6250 - RNA, 19 nt, artificial
  Completely synthesized
gauuuagaucauuugaaag

SEQ ID NO: 6251 - RNA, 19 nt, artificial
  Completely synthesized
ggacauugagcaaguuugg

SEQ ID NO: 6252 - RNA, 19 nt, artificial
  Completely synthesized
gaaaacuggaaaauauagu

SEQ ID NO: 6253 - RNA, 19 nt, artificial
  Completely synthesized
aaaacuugaaaaggaaaga

SEQ ID NO: 6254 - RNA, 19 nt, artificial
  Completely synthesized
ccacauuuucuuaaugcuu

SEQ ID NO: 6255 - RNA, 19 nt, artificial
  Completely synthesized
agaaaauaauacgaaacuu

SEQ ID NO: 6256 - RNA, 19 nt, artificial
  Completely synthesized
aaguaauucuaugcaaaau

SEQ ID NO: 6257 - RNA, 19 nt, artificial
  Completely synthesized
auguuuuccuuguucccaa

SEQ ID NO: 6258 - RNA, 19 nt, artificial
  Completely synthesized
caguggaucugccaacuac

SEQ ID NO: 6259 - RNA, 19 nt, artificial
  Completely synthesized
aacuguaaacaauuucuua

SEQ ID NO: 6260 - RNA, 19 nt, artificial
  Completely synthesized
agaaaacuggaaaauauag

SEQ ID NO: 6261 - RNA, 19 nt, artificial
  Completely synthesized
gacaauuaucauuuuuacu

SEQ ID NO: 6262 - RNA, 19 nt, artificial
  Completely synthesized
gauuugauugacauacuuu

SEQ ID NO: 6263 - RNA, 19 nt, artificial
  Completely synthesized
caacacagauuuuggugau

SEQ ID NO: 6264 - RNA, 19 nt, artificial
  Completely synthesized
aaaucauagccaaaacuag

SEQ ID NO: 6265 - RNA, 19 nt, artificial
  Completely synthesized
uaaaagcuccuacugugau

SEQ ID NO: 6266 - RNA, 19 nt, artificial
  Completely synthesized
aagaaauuauugcaaaacu

SEQ ID NO: 6267 - RNA, 19 nt, artificial
  Completely synthesized
cuuuauaaguaauucuaug

SEQ ID NO: 6268 - RNA, 19 nt, artificial
  Completely synthesized
gaaguugacaauuaucauu

SEQ ID NO: 6269 - RNA, 19 nt, artificial
  Completely synthesized
cauuugggcuaguuucugu

SEQ ID NO: 6270 - RNA, 19 nt, artificial
  Completely synthesized
guaaauacuacaaaaacuu

SEQ ID NO: 6271 - RNA, 19 nt, artificial
  Completely synthesized
aaaacaccaguacauucuu

SEQ ID NO: 6272 - RNA, 19 nt, artificial
  Completely synthesized
aauuuuauucugcuuucau

SEQ ID NO: 6273 - RNA, 19 nt, artificial
  Completely synthesized
gcauuucacuaaacacaag

SEQ ID NO: 6274 - RNA, 19 nt, artificial
  Completely synthesized
agcaguucaaugaagcuca

SEQ ID NO: 6275 - RNA, 19 nt, artificial
  Completely synthesized
augaagauggaaaaccuua

SEQ ID NO: 6276 - RNA, 19 nt, artificial
  Completely synthesized
acuaaaagcuccuacugug

SEQ ID NO: 6277 - RNA, 19 nt, artificial
  Completely synthesized
aaagaaaaauugcucaaag

SEQ ID NO: 6278 - RNA, 19 nt, artificial
  Completely synthesized
uucacaaaagacaaacauu

SEQ ID NO: 6279 - RNA, 19 nt, artificial
  Completely synthesized
uguaaacaauuucuuagga

SEQ ID NO: 6280 - RNA, 19 nt, artificial
  Completely synthesized
uagaucauuugaaagauga

SEQ ID NO: 6281 - RNA, 19 nt, artificial
  Completely synthesized
gaaagcacagcagaauuca

SEQ ID NO: 6282 - RNA, 19 nt, artificial
  Completely synthesized
gauuuuggugaugaauuuu

SEQ ID NO: 6283 - RNA, 19 nt, artificial
  Completely synthesized
cuuuaacuguaaacaauuu

SEQ ID NO: 6284 - RNA, 19 nt, artificial
  Completely synthesized
aguuucacuuuaacuguaa

SEQ ID NO: 6285 - RNA, 19 nt, artificial
  Completely synthesized
aaaagcuccuacugugaug

SEQ ID NO: 6286 - RNA, 19 nt, artificial
  Completely synthesized
guaacuguaguccacauuu

SEQ ID NO: 6287 - RNA, 19 nt, artificial
  Completely synthesized
aucccauucccuguagaaa

SEQ ID NO: 6288 - RNA, 19 nt, artificial
  Completely synthesized
uaucccauucccuguagaa

SEQ ID NO: 6289 - RNA, 19 nt, artificial
  Completely synthesized
acagaaaaaacuugaaaag

SEQ ID NO: 6290 - RNA, 19 nt, artificial
  Completely synthesized
cuaguuucuguguaagugu

SEQ ID NO: 6291 - RNA, 19 nt, artificial
  Completely synthesized
guacuauuauacuaaaagc

SEQ ID NO: 6292 - RNA, 19 nt, artificial
  Completely synthesized
ugaaguggaagagcuagau

SEQ ID NO: 6293 - RNA, 19 nt, artificial
  Completely synthesized
cgugaugaagauggaaaac

SEQ ID NO: 6294 - RNA, 19 nt, artificial
  Completely synthesized
guaauucuaugcaaaauca

SEQ ID NO: 6295 - RNA, 19 nt, artificial
  Completely synthesized
uguagaaaaaaucauuaac

SEQ ID NO: 6296 - RNA, 19 nt, artificial
  Completely synthesized
aaugaagcucaacuugcau

SEQ ID NO: 6297 - RNA, 19 nt, artificial
  Completely synthesized
ucaguaguuucacuuuaac

SEQ ID NO: 6298 - RNA, 19 nt, artificial
  Completely synthesized
gcuauuauccauuccugag

SEQ ID NO: 6299 - RNA, 19 nt, artificial
  Completely synthesized
uaaccacuauguacuuuuu

SEQ ID NO: 6300 - RNA, 19 nt, artificial
  Completely synthesized
caguuacaacuagaugaag

SEQ ID NO: 6301 - RNA, 19 nt, artificial
  Completely synthesized
cacuacuuggccucaguga

SEQ ID NO: 6302 - RNA, 19 nt, artificial
  Completely synthesized
uauacuaaaagcuccuacu

SEQ ID NO: 6303 - RNA, 19 nt, artificial
  Completely synthesized
ccaaagagcaguucaauga

SEQ ID NO: 6304 - RNA, 19 nt, artificial
  Completely synthesized
agguugcccacauucccaa

SEQ ID NO: 6305 - RNA, 19 nt, artificial
  Completely synthesized
aaaaugacaagcugguuga

SEQ ID NO: 6306 - RNA, 19 nt, artificial
  Completely synthesized
aaaaucauagccaaaacua

SEQ ID NO: 6307 - RNA, 19 nt, artificial
  Completely synthesized
cugaaaaaacaacucagca

SEQ ID NO: 6308 - RNA, 19 nt, artificial
  Completely synthesized
cauuaaauucagaugccac

SEQ ID NO: 6309 - RNA, 19 nt, artificial
  Completely synthesized
cuuuggaggcaagauauag

SEQ ID NO: 6310 - RNA, 19 nt, artificial
  Completely synthesized
caaaucagaugcuuuguac

SEQ ID NO: 6311 - RNA, 19 nt, artificial
  Completely synthesized
guuacaacuagaugaagag

SEQ ID NO: 6312 - RNA, 19 nt, artificial
  Completely synthesized
augugaaaugcucauacuu

SEQ ID NO: 6313 - RNA, 19 nt, artificial
  Completely synthesized
gaaaauauaguagaacuag

SEQ ID NO: 6314 - RNA, 19 nt, artificial
  Completely synthesized
aucuauacccucaauggaa

SEQ ID NO: 6315 - RNA, 19 nt, artificial
  Completely synthesized
uguugaaucaguaguuuca

SEQ ID NO: 6316 - RNA, 19 nt, artificial
  Completely synthesized
uagauuuaggaggauuuga

SEQ ID NO: 6317 - RNA, 19 nt, artificial
  Completely synthesized
ccuaaaacaccaguacauu

SEQ ID NO: 6318 - RNA, 19 nt, artificial
  Completely synthesized
cucagaauugcagaaaaag

SEQ ID NO: 6319 - RNA, 19 nt, artificial
  Completely synthesized
aauaaaguggcugcucaga

SEQ ID NO: 6320 - RNA, 19 nt, artificial
  Completely synthesized
uuuggugaugaauuuuauu

SEQ ID NO: 6321 - RNA, 19 nt, artificial
  Completely synthesized
aaaucagaugcuuuguacu

SEQ ID NO: 6322 - RNA, 19 nt, artificial
  Completely synthesized
cuuauuuauacuguucuua

SEQ ID NO: 6323 - RNA, 19 nt, artificial
  Completely synthesized
uacuaaucaggcucaguca

SEQ ID NO: 6324 - RNA, 19 nt, artificial
  Completely synthesized
aaggaaagacaagaacaac

SEQ ID NO: 6325 - RNA, 19 nt, artificial
  Completely synthesized
caguaguuucacuuuaacu

SEQ ID NO: 6326 - RNA, 19 nt, artificial
  Completely synthesized
uguucuuaugucauuuguu

SEQ ID NO: 6327 - RNA, 19 nt, artificial
  Completely synthesized
ucuuaugucauuuguuaua

SEQ ID NO: 6328 - RNA, 19 nt, artificial
  Completely synthesized
auucacaaaagacaaacau

SEQ ID NO: 6329 - RNA, 19 nt, artificial
  Completely synthesized
gaaacuuuaaaaagcauug

SEQ ID NO: 6330 - RNA, 19 nt, artificial
  Completely synthesized
ugacuccggcauuucacua

SEQ ID NO: 6331 - RNA, 19 nt, artificial
  Completely synthesized
cacuaaacacaagucccag

SEQ ID NO: 6332 - RNA, 19 nt, artificial
  Completely synthesized
cuauuauacuaaaagcucc

SEQ ID NO: 6333 - RNA, 19 nt, artificial
  Completely synthesized
ccggcauuucacuaaacac

SEQ ID NO: 6334 - RNA, 19 nt, artificial
  Completely synthesized
aaaaagaaaacuggaaaau

SEQ ID NO: 6335 - RNA, 19 nt, artificial
  Completely synthesized
guaguuucacuuuaacugu

SEQ ID NO: 6336 - RNA, 19 nt, artificial
  Completely synthesized
agucagcgacggaaagagu

SEQ ID NO: 6337 - RNA, 19 nt, artificial
  Completely synthesized
acauuuucuuaaugcuuuu

SEQ ID NO: 6338 - RNA, 19 nt, artificial
  Completely synthesized
uguaaguguaaauacuaca

SEQ ID NO: 6339 - RNA, 19 nt, artificial
  Completely synthesized
uuauacuguucuuauguca

SEQ ID NO: 6340 - RNA, 19 nt, artificial
  Completely synthesized
ccaaaucagaugcuuugua

SEQ ID NO: 6341 - RNA, 19 nt, artificial
  Completely synthesized
aaaagccuucaccuacuga

SEQ ID NO: 6342 - RNA, 19 nt, artificial
  Completely synthesized
uauugaaaaugacaagcug

SEQ ID NO: 6343 - RNA, 19 nt, artificial
  Completely synthesized
uaauauugaaaaugacaag

SEQ ID NO: 6344 - RNA, 19 nt, artificial
  Completely synthesized
acaccauuugggcuaguuu

SEQ ID NO: 6345 - RNA, 19 nt, artificial
  Completely synthesized
aaaucauuaaccucccugu

SEQ ID NO: 6346 - RNA, 19 nt, artificial
  Completely synthesized
aacuuuaaaaagcauugga

SEQ ID NO: 6347 - RNA, 19 nt, artificial
  Completely synthesized
auuuuggugaugaauuuua

SEQ ID NO: 6348 - RNA, 19 nt, artificial
  Completely synthesized
cggaaagaguaugagcugg

SEQ ID NO: 6349 - RNA, 19 nt, artificial
  Completely synthesized
cuuucauagcugagcccag

SEQ ID NO: 6350 - RNA, 19 nt, artificial
  Completely synthesized
ugacaaugagguuucuucg

SEQ ID NO: 6351 - RNA, 19 nt, artificial
  Completely synthesized
ccuagugaauacucccugc

SEQ ID NO: 6352 - RNA, 19 nt, artificial
  Completely synthesized
uuuucuuaaugcuuuugag

SEQ ID NO: 6353 - RNA, 19 nt, artificial
  Completely synthesized
gauugacauacuuuggagg

SEQ ID NO: 6354 - RNA, 19 nt, artificial
  Completely synthesized
gagaacacaccagagaaag

SEQ ID NO: 6355 - RNA, 19 nt, artificial
  Completely synthesized
gacaggugaauuucuccca

SEQ ID NO: 6356 - RNA, 19 nt, artificial
  Completely synthesized
cuuuguacuuugaugacug

SEQ ID NO: 6357 - RNA, 19 nt, artificial
  Completely synthesized
agacgguaugcaacaggac

SEQ ID NO: 6358 - RNA, 19 nt, artificial
  Completely synthesized
ucuggcuaaaaagaaauua

SEQ ID NO: 6359 - RNA, 19 nt, artificial
  Completely synthesized
uagccaaaacuaguauaga

SEQ ID NO: 6360 - RNA, 19 nt, artificial
  Completely synthesized
cucauacuuuauaaguaau

SEQ ID NO: 6361 - RNA, 19 nt, artificial
  Completely synthesized
ggcaucaccagaacacuca

SEQ ID NO: 6362 - RNA, 19 nt, artificial
  Completely synthesized
agcaagauuuagaucauuu

SEQ ID NO: 6363 - RNA, 19 nt, artificial
  Completely synthesized
ugacaauuaucauuuuuac

SEQ ID NO: 6364 - RNA, 19 nt, artificial
  Completely synthesized
cagagaaagaauugccugu

SEQ ID NO: 6365 - RNA, 19 nt, artificial
  Completely synthesized
uucuguguaaguguaaaua

SEQ ID NO: 6366 - RNA, 19 nt, artificial
  Completely synthesized
gaugaaaaagaaaaauugc

SEQ ID NO: 6367 - RNA, 19 nt, artificial
  Completely synthesized
aguguggcaucaccagaac

SEQ ID NO: 6368 - RNA, 19 nt, artificial
  Completely synthesized
aaucauuaaccucccuguu

SEQ ID NO: 6369 - RNA, 19 nt, artificial
  Completely synthesized
cuccauaucccauucccug

SEQ ID NO: 6370 - RNA, 19 nt, artificial
  Completely synthesized
ccaaaaccacccugaaagc

SEQ ID NO: 6371 - RNA, 19 nt, artificial
  Completely synthesized
cuaguuuuuuuguacuauu

SEQ ID NO: 6372 - RNA, 19 nt, artificial
  Completely synthesized
gcucaacuugcauuaauuc

SEQ ID NO: 6373 - RNA, 19 nt, artificial
  Completely synthesized
auuugacuucagucagcga

SEQ ID NO: 6374 - RNA, 19 nt, artificial
  Completely synthesized
ccucaccugcuacuuuaag

SEQ ID NO: 6375 - RNA, 19 nt, artificial
  Completely synthesized
cccaaccaguugacaguga

SEQ ID NO: 6376 - RNA, 19 nt, artificial
  Completely synthesized
caaugugagaacacaccag

SEQ ID NO: 6377 - RNA, 19 nt, artificial
  Completely synthesized
ugcaaaaucauagccaaaa

SEQ ID NO: 6378 - RNA, 19 nt, artificial
  Completely synthesized
agcugguugagacuaccau

SEQ ID NO: 6379 - RNA, 19 nt, artificial
  Completely synthesized
auacuguucuuaugucauu

SEQ ID NO: 6380 - RNA, 19 nt, artificial
  Completely synthesized
auuucuuaggacaccauuu

SEQ ID NO: 6381 - RNA, 19 nt, artificial
  Completely synthesized
aaaacuaaccacuauguac

SEQ ID NO: 6382 - RNA, 19 nt, artificial
  Completely synthesized
ucauagccaaaacuaguau

SEQ ID NO: 6383 - RNA, 19 nt, artificial
  Completely synthesized
ugaaaaugacaagcugguu

SEQ ID NO: 6384 - RNA, 19 nt, artificial
  Completely synthesized
uccagaagccaaacugaca

SEQ ID NO: 6385 - RNA, 19 nt, artificial
  Completely synthesized
agcuuuuggcgcagacauu

SEQ ID NO: 6386 - RNA, 19 nt, artificial
  Completely synthesized
aucauagccaaaacuagua

SEQ ID NO: 6387 - RNA, 19 nt, artificial
  Completely synthesized
uccauaucccauucccugu

SEQ ID NO: 6388 - RNA, 19 nt, artificial
  Completely synthesized
uguugauuuagacgguaug

SEQ ID NO: 6389 - RNA, 19 nt, artificial
  Completely synthesized
ccauucacucucugaacuu

SEQ ID NO: 6390 - RNA, 19 nt, artificial
  Completely synthesized
caacuagaugaagagacag

SEQ ID NO: 6391 - RNA, 19 nt, artificial
  Completely synthesized
uauuuauacuguucuuaug

SEQ ID NO: 6392 - RNA, 19 nt, artificial
  Completely synthesized
aacuaaccacuauguacuu

SEQ ID NO: 6393 - RNA, 19 nt, artificial
  Completely synthesized
gaaaaagaaguagguaacu

SEQ ID NO: 6394 - RNA, 19 nt, artificial
  Completely synthesized
ccauucacaaaagacaaac

SEQ ID NO: 6395 - RNA, 19 nt, artificial
  Completely synthesized
gaugacaaugagguuucuu

SEQ ID NO: 6396 - RNA, 19 nt, artificial
  Completely synthesized
uauacuguucuuaugucau

SEQ ID NO: 6397 - RNA, 19 nt, artificial
  Completely synthesized
guggcaucaccagaacacu

SEQ ID NO: 6398 - RNA, 19 nt, artificial
  Completely synthesized
uuugcaaagcuuucaacca

SEQ ID NO: 6399 - RNA, 19 nt, artificial
  Completely synthesized
cacauuuucuuaaugcuuu

SEQ ID NO: 6400 - RNA, 19 nt, artificial
  Completely synthesized
uuuagaucauuugaaagau

SEQ ID NO: 6401 - RNA, 19 nt, artificial
  Completely synthesized
uagaaaaaaucauuaaccu

SEQ ID NO: 6402 - RNA, 19 nt, artificial
  Completely synthesized
auuucucccaauucagcca

SEQ ID NO: 6403 - RNA, 19 nt, artificial
  Completely synthesized
cuuguucccaaaaguaaga

SEQ ID NO: 6404 - RNA, 19 nt, artificial
  Completely synthesized
aaauauaguagaacuagag

SEQ ID NO: 6405 - RNA, 19 nt, artificial
  Completely synthesized
acuuggccucagugauucu

SEQ ID NO: 6406 - RNA, 19 nt, artificial
  Completely synthesized
auuauccauuccugaguua

SEQ ID NO: 6407 - RNA, 19 nt, artificial
  Completely synthesized
guacuaauaaaggauuauu

SEQ ID NO: 6408 - RNA, 19 nt, artificial
  Completely synthesized
aauuucuuaggacaccauu

SEQ ID NO: 6409 - RNA, 19 nt, artificial
  Completely synthesized
gaaagacaagaacaacucc

SEQ ID NO: 6410 - RNA, 19 nt, artificial
  Completely synthesized
gguaacuguaguccacauu

SEQ ID NO: 6411 - RNA, 19 nt, artificial
  Completely synthesized
gaauuucucccaauucagc

SEQ ID NO: 6412 - RNA, 19 nt, artificial
  Completely synthesized
aagaagccagauguuaaga

SEQ ID NO: 6413 - RNA, 19 nt, artificial
  Completely synthesized
aaaguggcugcucagaauu

SEQ ID NO: 6414 - RNA, 19 nt, artificial
  Completely synthesized
gagacacacuacuuggccu

SEQ ID NO: 6415 - RNA, 19 nt, artificial
  Completely synthesized
uaugguacaacccuuguca

SEQ ID NO: 6416 - RNA, 19 nt, artificial
  Completely synthesized
aagaacaacuccaaaagga

SEQ ID NO: 6417 - RNA, 19 nt, artificial
  Completely synthesized
ugucaaacagaaugguccu

SEQ ID NO: 6418 - RNA, 19 nt, artificial
  Completely synthesized
aagucccaguguggcauca

SEQ ID NO: 6419 - RNA, 19 nt, artificial
  Completely synthesized
caggacauugagcaaguuu

SEQ ID NO: 6420 - RNA, 19 nt, artificial
  Completely synthesized
aaagaaaaaggagaaaaug

SEQ ID NO: 6421 - RNA, 19 nt, artificial
  Completely synthesized
gaaucuuccagcuauggag

SEQ ID NO: 6422 - RNA, 19 nt, artificial
  Completely synthesized
gaugaacuuagggcaaaag

SEQ ID NO: 6423 - RNA, 19 nt, artificial
  Completely synthesized
gccagauguuaagaaaaac

SEQ ID NO: 6424 - RNA, 19 nt, artificial
  Completely synthesized
gcuaguuuuuuuguacuau

SEQ ID NO: 6425 - RNA, 19 nt, artificial
  Completely synthesized
ccuacugugaugugaaaug

SEQ ID NO: 6426 - RNA, 19 nt, artificial
  Completely synthesized
caaaaggagcaagagaaag

SEQ ID NO: 6427 - RNA, 19 nt, artificial
  Completely synthesized
acuuguuccugauauuccc

SEQ ID NO: 6428 - RNA, 19 nt, artificial
  Completely synthesized
guccacagcucaucaugau

SEQ ID NO: 6429 - RNA, 19 nt, artificial
  Completely synthesized
uauuauacuaaaagcuccu

SEQ ID NO: 6430 - RNA, 19 nt, artificial
  Completely synthesized
augacaaaagccuucaccu

SEQ ID NO: 6431 - RNA, 19 nt, artificial
  Completely synthesized
gcuaguuucuguguaagug

SEQ ID NO: 6432 - RNA, 19 nt, artificial
  Completely synthesized
cuuaugucauuuguuauau

SEQ ID NO: 6433 - RNA, 19 nt, artificial
  Completely synthesized
auuauugcaaaacuaacca

SEQ ID NO: 6434 - RNA, 19 nt, artificial
  Completely synthesized
augucauuuguuauauuca

SEQ ID NO: 6435 - RNA, 19 nt, artificial
  Completely synthesized
aacucagcaccuuauaucu

SEQ ID NO: 6436 - RNA, 19 nt, artificial
  Completely synthesized
uaugagcuggaaaaacaga

SEQ ID NO: 6437 - RNA, 19 nt, artificial
  Completely synthesized
cagacauucccguuuguag

SEQ ID NO: 6438 - RNA, 19 nt, artificial
  Completely synthesized
aauacgaaacuuuaaaaag

SEQ ID NO: 6439 - RNA, 19 nt, artificial
  Completely synthesized
gguacaacccuugucacca

SEQ ID NO: 6440 - RNA, 19 nt, artificial
  Completely synthesized
ggacaccauuugggcuagu

SEQ ID NO: 6441 - RNA, 19 nt, artificial
  Completely synthesized
acgguaugcaacaggacau

SEQ ID NO: 6442 - RNA, 19 nt, artificial
  Completely synthesized
ugaacuuagggcaaaagcu

SEQ ID NO: 6443 - RNA, 19 nt, artificial
  Completely synthesized
acuuuaacuguaaacaauu

SEQ ID NO: 6444 - RNA, 19 nt, artificial
  Completely synthesized
uacugugaugugaaaugcu

SEQ ID NO: 6445 - RNA, 19 nt, artificial
  Completely synthesized
aacuguaguccacauuuuc

SEQ ID NO: 6446 - RNA, 19 nt, artificial
  Completely synthesized
cucacaagagaugaacuua

SEQ ID NO: 6447 - RNA, 19 nt, artificial
  Completely synthesized
gaacucauuaaauucagau

SEQ ID NO: 6448 - RNA, 19 nt, artificial
  Completely synthesized
gcuacuaaucaggcucagu

SEQ ID NO: 6449 - RNA, 19 nt, artificial
  Completely synthesized
ucagcaugcuacgugauga

SEQ ID NO: 6450 - RNA, 19 nt, artificial
  Completely synthesized
ugauucugacuccggcauu

SEQ ID NO: 6451 - RNA, 19 nt, artificial
  Completely synthesized
caaaaccacccugaaagca

SEQ ID NO: 6452 - RNA, 19 nt, artificial
  Completely synthesized
auuugauugacauacuuug

SEQ ID NO: 6453 - RNA, 19 nt, artificial
  Completely synthesized
uuguugacuucaacgaaau

SEQ ID NO: 6454 - RNA, 19 nt, artificial
  Completely synthesized
ucuccauaucccauucccu

SEQ ID NO: 6455 - RNA, 19 nt, artificial
  Completely synthesized
cauaucccauucccuguag

SEQ ID NO: 6456 - RNA, 19 nt, artificial
  Completely synthesized
cuauggagacacacuacuu

SEQ ID NO: 6457 - RNA, 19 nt, artificial
  Completely synthesized
uagugaauacucccugcag

SEQ ID NO: 6458 - RNA, 19 nt, artificial
  Completely synthesized
cuguuguugacuucaacga

SEQ ID NO: 6459 - RNA, 19 nt, artificial
  Completely synthesized
auggaaaaagaaguaggua

SEQ ID NO: 6460 - RNA, 19 nt, artificial
  Completely synthesized
caauguuuuccuuguuccc

SEQ ID NO: 6461 - RNA, 19 nt, artificial
  Completely synthesized
gagcacucacgugcaugau

SEQ ID NO: 6462 - RNA, 19 nt, artificial
  Completely synthesized
ugaauuucucccaauucag

SEQ ID NO: 6463 - RNA, 19 nt, artificial
  Completely synthesized
aaaaaucauuaaccucccu

SEQ ID NO: 6464 - RNA, 19 nt, artificial
  Completely synthesized
agaacaacuccaaaaggag

SEQ ID NO: 6465 - RNA, 19 nt, artificial
  Completely synthesized
uuccuuuucaaguuuuuuc

SEQ ID NO: 6466 - RNA, 19 nt, artificial
  Completely synthesized
uuuuucuuuuucaucuuuc

SEQ ID NO: 6467 - RNA, 19 nt, artificial
  Completely synthesized
uuuucuauacuaguuuugg

SEQ ID NO: 6468 - RNA, 19 nt, artificial
  Completely synthesized
uuucaaaugaucuaaaucu

SEQ ID NO: 6469 - RNA, 19 nt, artificial
  Completely synthesized
uuuuguaguauuuacacuu

SEQ ID NO: 6470 - RNA, 19 nt, artificial
  Completely synthesized
uuucuuugagcaauuuuuc

SEQ ID NO: 6471 - RNA, 19 nt, artificial
  Completely synthesized
uuuuccaguuuucuuuuuc

SEQ ID NO: 6472 - RNA, 19 nt, artificial
  Completely synthesized
uuuucuuugagcaauuuuu

SEQ ID NO: 6473 - RNA, 19 nt, artificial
  Completely synthesized
uuaguuuugcaauaauuuc

SEQ ID NO: 6474 - RNA, 19 nt, artificial
  Completely synthesized
uuuugguugaaagcuuugc

SEQ ID NO: 6475 - RNA, 19 nt, artificial
  Completely synthesized
uucuacuauauuuuccagu

SEQ ID NO: 6476 - RNA, 19 nt, artificial
  Completely synthesized
uaguucuacuauauuuucc

SEQ ID NO: 6477 - RNA, 19 nt, artificial
  Completely synthesized
ugcaaguugagcuucauug

SEQ ID NO: 6478 - RNA, 19 nt, artificial
  Completely synthesized
aaguuuuuucuguuuuucc

SEQ ID NO: 6479 - RNA, 19 nt, artificial
  Completely synthesized
uuucuuuuucugcaauucu

SEQ ID NO: 6480 - RNA, 19 nt, artificial
  Completely synthesized
uuuuuguccauacaguauu

SEQ ID NO: 6481 - RNA, 19 nt, artificial
  Completely synthesized
auuuucuccuuuuucuuug

SEQ ID NO: 6482 - RNA, 19 nt, artificial
  Completely synthesized
uaaaucuugcucuaguucu

SEQ ID NO: 6483 - RNA, 19 nt, artificial
  Completely synthesized
uauauuuuccaguuuucuu

SEQ ID NO: 6484 - RNA, 19 nt, artificial
  Completely synthesized
uaguuuugcaauaauuucu

SEQ ID NO: 6485 - RNA, 19 nt, artificial
  Completely synthesized
uuaaugauuuuuucuacag

SEQ ID NO: 6486 - RNA, 19 nt, artificial
  Completely synthesized
uaaaaaaugccauuuuuug

SEQ ID NO: 6487 - RNA, 19 nt, artificial
  Completely synthesized
uuauaaaguaugagcauuu

SEQ ID NO: 6488 - RNA, 19 nt, artificial
  Completely synthesized
uuucaauauuaagacacug

SEQ ID NO: 6489 - RNA, 19 nt, artificial
  Completely synthesized
uucaauauuaagacacugu

SEQ ID NO: 6490 - RNA, 19 nt, artificial
  Completely synthesized
uucuuuuucaucuuucaaa

SEQ ID NO: 6491 - RNA, 19 nt, artificial
  Completely synthesized
auauuuuccaguuuucuuu

SEQ ID NO: 6492 - RNA, 19 nt, artificial
  Completely synthesized
uuuccaguuuucuuuuucu

SEQ ID NO: 6493 - RNA, 19 nt, artificial
  Completely synthesized
uuuucuuuuucugcaauuc

SEQ ID NO: 6494 - RNA, 19 nt, artificial
  Completely synthesized
auuuucaauauuaagacac

SEQ ID NO: 6495 - RNA, 19 nt, artificial
  Completely synthesized
uaaugauuuuuucuacagg

SEQ ID NO: 6496 - RNA, 19 nt, artificial
  Completely synthesized
uuugucauuuucuccuuuu

SEQ ID NO: 6497 - RNA, 19 nt, artificial
  Completely synthesized
ucuaguucuacuauauuuu

SEQ ID NO: 6498 - RNA, 19 nt, artificial
  Completely synthesized
uuacuuauaaaguaugagc

SEQ ID NO: 6499 - RNA, 19 nt, artificial
  Completely synthesized
auuuucuauacuaguuuug

SEQ ID NO: 6500 - RNA, 19 nt, artificial
  Completely synthesized
auuguuuacaguuaaagug

SEQ ID NO: 6501 - RNA, 19 nt, artificial
  Completely synthesized
uugaauguuugucuuuugu

SEQ ID NO: 6502 - RNA, 19 nt, artificial
  Completely synthesized
uucaaguuuuuucuguuuu

SEQ ID NO: 6503 - RNA, 19 nt, artificial
  Completely synthesized
uccuuuucaaguuuuuucu

SEQ ID NO: 6504 - RNA, 19 nt, artificial
  Completely synthesized
uuugcugcagggaguauuc

SEQ ID NO: 6505 - RNA, 19 nt, artificial
  Completely synthesized
uuuucaaguuuuuucuguu

SEQ ID NO: 6506 - RNA, 19 nt, artificial
  Completely synthesized
ugaguaaaaaugauaauug

SEQ ID NO: 6507 - RNA, 19 nt, artificial
  Completely synthesized
acuuacaggcaauucuuuc

SEQ ID NO: 6508 - RNA, 19 nt, artificial
  Completely synthesized
uucuuugagcaauuuuucu

SEQ ID NO: 6509 - RNA, 19 nt, artificial
  Completely synthesized
uuuccuuuucaaguuuuuu

SEQ ID NO: 6510 - RNA, 19 nt, artificial
  Completely synthesized
uuuucuuuuucaucuuuca

SEQ ID NO: 6511 - RNA, 19 nt, artificial
  Completely synthesized
uuuagccagaugucauauc

SEQ ID NO: 6512 - RNA, 19 nt, artificial
  Completely synthesized
uuugcauagaauuacuuau

SEQ ID NO: 6513 - RNA, 19 nt, artificial
  Completely synthesized
uuuuucaucuuucaaauga

SEQ ID NO: 6514 - RNA, 19 nt, artificial
  Completely synthesized
uuucuuuuucaucuuucaa

SEQ ID NO: 6515 - RNA, 19 nt, artificial
  Completely synthesized
ucaaaugaucuaaaucuug

SEQ ID NO: 6516 - RNA, 19 nt, artificial
  Completely synthesized
ucuuugagcaauuuuucuu

SEQ ID NO: 6517 - RNA, 19 nt, artificial
  Completely synthesized
uuuuucuuugagcaauuuu

SEQ ID NO: 6518 - RNA, 19 nt, artificial
  Completely synthesized
uuaaagugaaacuacugau

SEQ ID NO: 6519 - RNA, 19 nt, artificial
  Completely synthesized
uuuugcauagaauuacuua

SEQ ID NO: 6520 - RNA, 19 nt, artificial
  Completely synthesized
uuuuuuguccauacaguau

SEQ ID NO: 6521 - RNA, 19 nt, artificial
  Completely synthesized
uuucugacuggaugugcug

SEQ ID NO: 6522 - RNA, 19 nt, artificial
  Completely synthesized
ucauuuucaauauuaagac

SEQ ID NO: 6523 - RNA, 19 nt, artificial
  Completely synthesized
uuuugucauuuucuccuuu

SEQ ID NO: 6524 - RNA, 19 nt, artificial
  Completely synthesized
aaauucaucaccaaaaucu

SEQ ID NO: 6525 - RNA, 19 nt, artificial
  Completely synthesized
uauuuuccaguuuucuuuu

SEQ ID NO: 6526 - RNA, 19 nt, artificial
  Completely synthesized
uucaucuuucaaaugaucu

SEQ ID NO: 6527 - RNA, 19 nt, artificial
  Completely synthesized
uuucaaguuuuuucuguuu

SEQ ID NO: 6528 - RNA, 19 nt, artificial
  Completely synthesized
uauaaaaaaguacauagug

SEQ ID NO: 6529 - RNA, 19 nt, artificial
  Completely synthesized
uuuccauugaggguauaga

SEQ ID NO: 6530 - RNA, 19 nt, artificial
  Completely synthesized
uaugaaagcagaauaaaau

SEQ ID NO: 6531 - RNA, 19 nt, artificial
  Completely synthesized
aaaaaugccauuuuuuguc

SEQ ID NO: 6532 - RNA, 19 nt, artificial
  Completely synthesized
uuguuuacaguuaaaguga

SEQ ID NO: 6533 - RNA, 19 nt, artificial
  Completely synthesized
ucauuuucuccuuuuucuu

SEQ ID NO: 6534 - RNA, 19 nt, artificial
  Completely synthesized
auaauuucuuuuuagccag

SEQ ID NO: 6535 - RNA, 19 nt, artificial
  Completely synthesized
auaaaauucaucaccaaaa

SEQ ID NO: 6536 - RNA, 19 nt, artificial
  Completely synthesized
ucuaugaauauaacaaaug

SEQ ID NO: 6537 - RNA, 19 nt, artificial
  Completely synthesized
aucaucauauaaaucuaug

SEQ ID NO: 6538 - RNA, 19 nt, artificial
  Completely synthesized
uaggagaauaagguuuucc

SEQ ID NO: 6539 - RNA, 19 nt, artificial
  Completely synthesized
uaucuagcucuuccacuuc

SEQ ID NO: 6540 - RNA, 19 nt, artificial
  Completely synthesized
auaaaaaaguacauagugg

SEQ ID NO: 6541 - RNA, 19 nt, artificial
  Completely synthesized
ugaaagcagaauaaaauuc

SEQ ID NO: 6542 - RNA, 19 nt, artificial
  Completely synthesized
ucuaguuuuucuuaacauc

SEQ ID NO: 6543 - RNA, 19 nt, artificial
  Completely synthesized
uucaaaugaucuaaaucuu

SEQ ID NO: 6544 - RNA, 19 nt, artificial
  Completely synthesized
uuguccauacaguauuuau

SEQ ID NO: 6545 - RNA, 19 nt, artificial
  Completely synthesized
uuuuuguaguauuuacacu

SEQ ID NO: 6546 - RNA, 19 nt, artificial
  Completely synthesized
ugucauuuucaauauuaag

SEQ ID NO: 6547 - RNA, 19 nt, artificial
  Completely synthesized
uauagaugaguaaaaauga

SEQ ID NO: 6548 - RNA, 19 nt, artificial
  Completely synthesized
uaacaaaugacauaagaac

SEQ ID NO: 6549 - RNA, 19 nt, artificial
  Completely synthesized
uaauccuuuauuaguacca

SEQ ID NO: 6550 - RNA, 19 nt, artificial
  Completely synthesized
aauauuaagacacuguaac

SEQ ID NO: 6551 - RNA, 19 nt, artificial
  Completely synthesized
auuuuuuguccauacagua

SEQ ID NO: 6552 - RNA, 19 nt, artificial
  Completely synthesized
uguccauacaguauuuaua

SEQ ID NO: 6553 - RNA, 19 nt, artificial
  Completely synthesized
uugucauuuucuccuuuuu

SEQ ID NO: 6554 - RNA, 19 nt, artificial
  Completely synthesized
uuucaucuuucaaaugauc

SEQ ID NO: 6555 - RNA, 19 nt, artificial
  Completely synthesized
uugcauagaauuacuuaua

SEQ ID NO: 6556 - RNA, 19 nt, artificial
  Completely synthesized
ucuacuauauuuuccaguu

SEQ ID NO: 6557 - RNA, 19 nt, artificial
  Completely synthesized
ucuugugagaugagccucc

SEQ ID NO: 6558 - RNA, 19 nt, artificial
  Completely synthesized
aguuuuuucuguuuuucca

SEQ ID NO: 6559 - RNA, 19 nt, artificial
  Completely synthesized
ucaauauuaagacacugua

SEQ ID NO: 6560 - RNA, 19 nt, artificial
  Completely synthesized
guauagaugaguaaaaaug

SEQ ID NO: 6561 - RNA, 19 nt, artificial
  Completely synthesized
ugagcaauuuuucuuuuuc

SEQ ID NO: 6562 - RNA, 19 nt, artificial
  Completely synthesized
uuuucaauauuaagacacu

SEQ ID NO: 6563 - RNA, 19 nt, artificial
  Completely synthesized
aauaauuucuuuuuagcca

SEQ ID NO: 6564 - RNA, 19 nt, artificial
  Completely synthesized
aauuuaaugaguucacugu

SEQ ID NO: 6565 - RNA, 19 nt, artificial
  Completely synthesized
uaguauuuacacuuacaca

SEQ ID NO: 6566 - RNA, 19 nt, artificial
  Completely synthesized
uuuacaguuaaagugaaac

SEQ ID NO: 6567 - RNA, 19 nt, artificial
  Completely synthesized
uacuauauuuuccaguuuu

SEQ ID NO: 6568 - RNA, 19 nt, artificial
  Completely synthesized
uaaaaaaguacauaguggu

SEQ ID NO: 6569 - RNA, 19 nt, artificial
  Completely synthesized
uacuuauaaaguaugagca

SEQ ID NO: 6570 - RNA, 19 nt, artificial
  Completely synthesized
ucuuuuucaucuuucaaau

SEQ ID NO: 6571 - RNA, 19 nt, artificial
  Completely synthesized
uccuaaaucuaguuuuucu

SEQ ID NO: 6572 - RNA, 19 nt, artificial
  Completely synthesized
aaaguuucguauuauuuuc

SEQ ID NO: 6573 - RNA, 19 nt, artificial
  Completely synthesized
agcagaauaaaauucauca

SEQ ID NO: 6574 - RNA, 19 nt, artificial
  Completely synthesized
aguucuacuauauuuucca

SEQ ID NO: 6575 - RNA, 19 nt, artificial
  Completely synthesized
augcuuuuuaaaguuucgu

SEQ ID NO: 6576 - RNA, 19 nt, artificial
  Completely synthesized
ucugaauuuaaugaguuca

SEQ ID NO: 6577 - RNA, 19 nt, artificial
  Completely synthesized
aaguugagcuucauugaac

SEQ ID NO: 6578 - RNA, 19 nt, artificial
  Completely synthesized
uagaugaguaaaaaugaua

SEQ ID NO: 6579 - RNA, 19 nt, artificial
  Completely synthesized
augauaauugucaacuucu

SEQ ID NO: 6580 - RNA, 19 nt, artificial
  Completely synthesized
ugcaauaauuucuuuuuag

SEQ ID NO: 6581 - RNA, 19 nt, artificial
  Completely synthesized
uaugaauauaacaaaugac

SEQ ID NO: 6582 - RNA, 19 nt, artificial
  Completely synthesized
uaguuuuucuuaacaucug

SEQ ID NO: 6583 - RNA, 19 nt, artificial
  Completely synthesized
uuguaguauuuacacuuac

SEQ ID NO: 6584 - RNA, 19 nt, artificial
  Completely synthesized
uuuguaguauuuacacuua

SEQ ID NO: 6585 - RNA, 19 nt, artificial
  Completely synthesized
uuuguccauacaguauuua

SEQ ID NO: 6586 - RNA, 19 nt, artificial
  Completely synthesized
uaaagugaaacuacugauu

SEQ ID NO: 6587 - RNA, 19 nt, artificial
  Completely synthesized
uuugagcaauuuuucuuuu

SEQ ID NO: 6588 - RNA, 19 nt, artificial
  Completely synthesized
uugguugaaagcuuugcaa

SEQ ID NO: 6589 - RNA, 19 nt, artificial
  Completely synthesized
augaauauaacaaaugaca

SEQ ID NO: 6590 - RNA, 19 nt, artificial
  Completely synthesized
aaaaugauaauugucaacu

SEQ ID NO: 6591 - RNA, 19 nt, artificial
  Completely synthesized
aaagugaaacuacugauuc

SEQ ID NO: 6592 - RNA, 19 nt, artificial
  Completely synthesized
auaauccuuuauuaguacc

SEQ ID NO: 6593 - RNA, 19 nt, artificial
  Completely synthesized
uuacuccaagaucuauauc

SEQ ID NO: 6594 - RNA, 19 nt, artificial
  Completely synthesized
aagaacaguauaaauaagu

SEQ ID NO: 6595 - RNA, 19 nt, artificial
  Completely synthesized
uauaaaguaugagcauuuc

SEQ ID NO: 6596 - RNA, 19 nt, artificial
  Completely synthesized
uaacaucuggcuucuuacu

SEQ ID NO: 6597 - RNA, 19 nt, artificial
  Completely synthesized
auuaagaaaauguggacua

SEQ ID NO: 6598 - RNA, 19 nt, artificial
  Completely synthesized
aaugcuuuuuaaaguuucg

SEQ ID NO: 6599 - RNA, 19 nt, artificial
  Completely synthesized
ugucauaucaucauauaaa

SEQ ID NO: 6600 - RNA, 19 nt, artificial
  Completely synthesized
ucauaucaucauauaaauc

SEQ ID NO: 6601 - RNA, 19 nt, artificial
  Completely synthesized
auauuaagacacuguaacu

SEQ ID NO: 6602 - RNA, 19 nt, artificial
  Completely synthesized
uugagcaauuuuucuuuuu

SEQ ID NO: 6603 - RNA, 19 nt, artificial
  Completely synthesized
gucauuuucaauauuaaga

SEQ ID NO: 6604 - RNA, 19 nt, artificial
  Completely synthesized
uucguauuauuuucuauac

SEQ ID NO: 6605 - RNA, 19 nt, artificial
  Completely synthesized
uuuuguccauacaguauuu

SEQ ID NO: 6606 - RNA, 19 nt, artificial
  Completely synthesized
cuaaaucuugcucuaguuc

SEQ ID NO: 6607 - RNA, 19 nt, artificial
  Completely synthesized
auaaaguaugagcauuuca

SEQ ID NO: 6608 - RNA, 19 nt, artificial
  Completely synthesized
uguccuaagaaauuguuua

SEQ ID NO: 6609 - RNA, 19 nt, artificial
  Completely synthesized
agguuuuccaucuucauca

SEQ ID NO: 6610 - RNA, 19 nt, artificial
  Completely synthesized
aagcagaauaaaauucauc

SEQ ID NO: 6611 - RNA, 19 nt, artificial
  Completely synthesized
cuaguuuuucuuaacaucu

SEQ ID NO: 6612 - RNA, 19 nt, artificial
  Completely synthesized
ucaaguuuuuucuguuuuu

SEQ ID NO: 6613 - RNA, 19 nt, artificial
  Completely synthesized
caauuuuucuuuuucaucu

SEQ ID NO: 6614 - RNA, 19 nt, artificial
  Completely synthesized
cauaucaucauauaaaucu

SEQ ID NO: 6615 - RNA, 19 nt, artificial
  Completely synthesized
caaguuuuuucuguuuuuc

SEQ ID NO: 6616 - RNA, 19 nt, artificial
  Completely synthesized
aaaugccggagucagaauc

SEQ ID NO: 6617 - RNA, 19 nt, artificial
  Completely synthesized
auucaucaccaaaaucugu

SEQ ID NO: 6618 - RNA, 19 nt, artificial
  Completely synthesized
aguuuuuguaguauuuaca

SEQ ID NO: 6619 - RNA, 19 nt, artificial
  Completely synthesized
ugcuuuuuaaaguuucgua

SEQ ID NO: 6620 - RNA, 19 nt, artificial
  Completely synthesized
aaaaaaugccauuuuuugu

SEQ ID NO: 6621 - RNA, 19 nt, artificial
  Completely synthesized
cuuugcaaagugauagauc

SEQ ID NO: 6622 - RNA, 19 nt, artificial
  Completely synthesized
guuaguuuugcaauaauuu

SEQ ID NO: 6623 - RNA, 19 nt, artificial
  Completely synthesized
uuuucuccuuuuucuuuga

SEQ ID NO: 6624 - RNA, 19 nt, artificial
  Completely synthesized
caauaauuucuuuuuagcc

SEQ ID NO: 6625 - RNA, 19 nt, artificial
  Completely synthesized
ugagauggugacaaggguu

SEQ ID NO: 6626 - RNA, 19 nt, artificial
  Completely synthesized
uaugauuuugcauagaauu

SEQ ID NO: 6627 - RNA, 19 nt, artificial
  Completely synthesized
cuuucaaaugaucuaaauc

SEQ ID NO: 6628 - RNA, 19 nt, artificial
  Completely synthesized
ccaaacuugcucaaugucc

SEQ ID NO: 6629 - RNA, 19 nt, artificial
  Completely synthesized
acuauauuuuccaguuuuc

SEQ ID NO: 6630 - RNA, 19 nt, artificial
  Completely synthesized
ucuuuccuuuucaaguuuu

SEQ ID NO: 6631 - RNA, 19 nt, artificial
  Completely synthesized
aagcauuaagaaaaugugg

SEQ ID NO: 6632 - RNA, 19 nt, artificial
  Completely synthesized
aaguuucguauuauuuucu

SEQ ID NO: 6633 - RNA, 19 nt, artificial
  Completely synthesized
auuuugcauagaauuacuu

SEQ ID NO: 6634 - RNA, 19 nt, artificial
  Completely synthesized
uugggaacaaggaaaacau

SEQ ID NO: 6635 - RNA, 19 nt, artificial
  Completely synthesized
guaguuggcagauccacug

SEQ ID NO: 6636 - RNA, 19 nt, artificial
  Completely synthesized
uaagaaauuguuuacaguu

SEQ ID NO: 6637 - RNA, 19 nt, artificial
  Completely synthesized
cuauauuuuccaguuuucu

SEQ ID NO: 6638 - RNA, 19 nt, artificial
  Completely synthesized
aguaaaaaugauaauuguc

SEQ ID NO: 6639 - RNA, 19 nt, artificial
  Completely synthesized
aaaguaugucaaucaaauc

SEQ ID NO: 6640 - RNA, 19 nt, artificial
  Completely synthesized
aucaccaaaaucuguguug

SEQ ID NO: 6641 - RNA, 19 nt, artificial
  Completely synthesized
cuaguuuuggcuaugauuu

SEQ ID NO: 6642 - RNA, 19 nt, artificial
  Completely synthesized
aucacaguaggagcuuuua

SEQ ID NO: 6643 - RNA, 19 nt, artificial
  Completely synthesized
aguuuugcaauaauuucuu

SEQ ID NO: 6644 - RNA, 19 nt, artificial
  Completely synthesized
cauagaauuacuuauaaag

SEQ ID NO: 6645 - RNA, 19 nt, artificial
  Completely synthesized
aaugauaauugucaacuuc

SEQ ID NO: 6646 - RNA, 19 nt, artificial
  Completely synthesized
acagaaacuagcccaaaug

SEQ ID NO: 6647 - RNA, 19 nt, artificial
  Completely synthesized
aaguuuuuguaguauuuac

SEQ ID NO: 6648 - RNA, 19 nt, artificial
  Completely synthesized
aagaauguacugguguuuu

SEQ ID NO: 6649 - RNA, 19 nt, artificial
  Completely synthesized
augaaagcagaauaaaauu

SEQ ID NO: 6650 - RNA, 19 nt, artificial
  Completely synthesized
cuuguguuuagugaaaugc

SEQ ID NO: 6651 - RNA, 19 nt, artificial
  Completely synthesized
ugagcuucauugaacugcu

SEQ ID NO: 6652 - RNA, 19 nt, artificial
  Completely synthesized
uaagguuuuccaucuucau

SEQ ID NO: 6653 - RNA, 19 nt, artificial
  Completely synthesized
cacaguaggagcuuuuagu

SEQ ID NO: 6654 - RNA, 19 nt, artificial
  Completely synthesized
cuuugagcaauuuuucuuu

SEQ ID NO: 6655 - RNA, 19 nt, artificial
  Completely synthesized
aauguuugucuuuugugaa

SEQ ID NO: 6656 - RNA, 19 nt, artificial
  Completely synthesized
uccuaagaaauuguuuaca

SEQ ID NO: 6657 - RNA, 19 nt, artificial
  Completely synthesized
ucaucuuucaaaugaucua

SEQ ID NO: 6658 - RNA, 19 nt, artificial
  Completely synthesized
ugaauucugcugugcuuuc

SEQ ID NO: 6659 - RNA, 19 nt, artificial
  Completely synthesized
aaaauucaucaccaaaauc

SEQ ID NO: 6660 - RNA, 19 nt, artificial
  Completely synthesized
aaauuguuuacaguuaaag

SEQ ID NO: 6661 - RNA, 19 nt, artificial
  Completely synthesized
uuacaguuaaagugaaacu

SEQ ID NO: 6662 - RNA, 19 nt, artificial
  Completely synthesized
caucacaguaggagcuuuu

SEQ ID NO: 6663 - RNA, 19 nt, artificial
  Completely synthesized
aaauguggacuacaguuac

SEQ ID NO: 6664 - RNA, 19 nt, artificial
  Completely synthesized
uuucuacagggaaugggau

SEQ ID NO: 6665 - RNA, 19 nt, artificial
  Completely synthesized
uucuacagggaaugggaua

SEQ ID NO: 6666 - RNA, 19 nt, artificial
  Completely synthesized
cuuuucaaguuuuuucugu

SEQ ID NO: 6667 - RNA, 19 nt, artificial
  Completely synthesized
acacuuacacagaaacuag

SEQ ID NO: 6668 - RNA, 19 nt, artificial
  Completely synthesized
gcuuuuaguauaauaguac

SEQ ID NO: 6669 - RNA, 19 nt, artificial
  Completely synthesized
aucuagcucuuccacuuca

SEQ ID NO: 6670 - RNA, 19 nt, artificial
  Completely synthesized
guuuuccaucuucaucacg

SEQ ID NO: 6671 - RNA, 19 nt, artificial
  Completely synthesized
ugauuuugcauagaauuac

SEQ ID NO: 6672 - RNA, 19 nt, artificial
  Completely synthesized
guuaaugauuuuuucuaca

SEQ ID NO: 6673 - RNA, 19 nt, artificial
  Completely synthesized
augcaaguugagcuucauu

SEQ ID NO: 6674 - RNA, 19 nt, artificial
  Completely synthesized
guuaaagugaaacuacuga

SEQ ID NO: 6675 - RNA, 19 nt, artificial
  Completely synthesized
cucaggaauggauaauagc

SEQ ID NO: 6676 - RNA, 19 nt, artificial
  Completely synthesized
aaaaaguacauagugguua

SEQ ID NO: 6677 - RNA, 19 nt, artificial
  Completely synthesized
cuucaucuaguuguaacug

SEQ ID NO: 6678 - RNA, 19 nt, artificial
  Completely synthesized
ucacugaggccaaguagug

SEQ ID NO: 6679 - RNA, 19 nt, artificial
  Completely synthesized
aguaggagcuuuuaguaua

SEQ ID NO: 6680 - RNA, 19 nt, artificial
  Completely synthesized
ucauugaacugcucuuugg

SEQ ID NO: 6681 - RNA, 19 nt, artificial
  Completely synthesized
uugggaaugugggcaaccu

SEQ ID NO: 6682 - RNA, 19 nt, artificial
  Completely synthesized
ucaaccagcuugucauuuu

SEQ ID NO: 6683 - RNA, 19 nt, artificial
  Completely synthesized
uaguuuuggcuaugauuuu

SEQ ID NO: 6684 - RNA, 19 nt, artificial
  Completely synthesized
ugcugaguuguuuuuucag

SEQ ID NO: 6685 - RNA, 19 nt, artificial
  Completely synthesized
guggcaucugaauuuaaug

SEQ ID NO: 6686 - RNA, 19 nt, artificial
  Completely synthesized
cuauaucuugccuccaaag

SEQ ID NO: 6687 - RNA, 19 nt, artificial
  Completely synthesized
guacaaagcaucugauuug

SEQ ID NO: 6688 - RNA, 19 nt, artificial
  Completely synthesized
cucuucaucuaguuguaac

SEQ ID NO: 6689 - RNA, 19 nt, artificial
  Completely synthesized
aaguaugagcauuucacau

SEQ ID NO: 6690 - RNA, 19 nt, artificial
  Completely synthesized
cuaguucuacuauauuuuc

SEQ ID NO: 6691 - RNA, 19 nt, artificial
  Completely synthesized
uuccauugaggguauagau

SEQ ID NO: 6692 - RNA, 19 nt, artificial
  Completely synthesized
ugaaacuacugauucaaca

SEQ ID NO: 6693 - RNA, 19 nt, artificial
  Completely synthesized
ucaaauccuccuaaaucua

SEQ ID NO: 6694 - RNA, 19 nt, artificial
  Completely synthesized
aauguacugguguuuuagg

SEQ ID NO: 6695 - RNA, 19 nt, artificial
  Completely synthesized
cuuuuucugcaauucugag

SEQ ID NO: 6696 - RNA, 19 nt, artificial
  Completely synthesized
ucugagcagccacuuuauu

SEQ ID NO: 6697 - RNA, 19 nt, artificial
  Completely synthesized
aauaaaauucaucaccaaa

SEQ ID NO: 6698 - RNA, 19 nt, artificial
  Completely synthesized
aguacaaagcaucugauuu

SEQ ID NO: 6699 - RNA, 19 nt, artificial
  Completely synthesized
uaagaacaguauaaauaag

SEQ ID NO: 6700 - RNA, 19 nt, artificial
  Completely synthesized
ugacugagccugauuagua

SEQ ID NO: 6701 - RNA, 19 nt, artificial
  Completely synthesized
guuguucuugucuuuccuu

SEQ ID NO: 6702 - RNA, 19 nt, artificial
  Completely synthesized
aguuaaagugaaacuacug

SEQ ID NO: 6703 - RNA, 19 nt, artificial
  Completely synthesized
aacaaaugacauaagaaca

SEQ ID NO: 6704 - RNA, 19 nt, artificial
  Completely synthesized
uauaacaaaugacauaaga

SEQ ID NO: 6705 - RNA, 19 nt, artificial
  Completely synthesized
auguuugucuuuugugaau

SEQ ID NO: 6706 - RNA, 19 nt, artificial
  Completely synthesized
caaugcuuuuuaaaguuuc

SEQ ID NO: 6707 - RNA, 19 nt, artificial
  Completely synthesized
uagugaaaugccggaguca

SEQ ID NO: 6708 - RNA, 19 nt, artificial
  Completely synthesized
cugggacuuguguuuagug

SEQ ID NO: 6709 - RNA, 19 nt, artificial
  Completely synthesized
ggagcuuuuaguauaauag

SEQ ID NO: 6710 - RNA, 19 nt, artificial
  Completely synthesized
guguuuagugaaaugccgg

SEQ ID NO: 6711 - RNA, 19 nt, artificial
  Completely synthesized
auuuuccaguuuucuuuuu

SEQ ID NO: 6712 - RNA, 19 nt, artificial
  Completely synthesized
acaguuaaagugaaacuac

SEQ ID NO: 6713 - RNA, 19 nt, artificial
  Completely synthesized
acucuuuccgucgcugacu

SEQ ID NO: 6714 - RNA, 19 nt, artificial
  Completely synthesized
aaaagcauuaagaaaaugu

SEQ ID NO: 6715 - RNA, 19 nt, artificial
  Completely synthesized
uguaguauuuacacuuaca

SEQ ID NO: 6716 - RNA, 19 nt, artificial
  Completely synthesized
ugacauaagaacaguauaa

SEQ ID NO: 6717 - RNA, 19 nt, artificial
  Completely synthesized
uacaaagcaucugauuugg

SEQ ID NO: 6718 - RNA, 19 nt, artificial
  Completely synthesized
ucaguaggugaaggcuuuu

SEQ ID NO: 6719 - RNA, 19 nt, artificial
  Completely synthesized
cagcuugucauuuucaaua

SEQ ID NO: 6720 - RNA, 19 nt, artificial
  Completely synthesized
cuugucauuuucaauauua

SEQ ID NO: 6721 - RNA, 19 nt, artificial
  Completely synthesized
aaacuagcccaaauggugu

SEQ ID NO: 6722 - RNA, 19 nt, artificial
  Completely synthesized
acagggagguuaaugauuu

SEQ ID NO: 6723 - RNA, 19 nt, artificial
  Completely synthesized
uccaaugcuuuuuaaaguu

SEQ ID NO: 6724 - RNA, 19 nt, artificial
  Completely synthesized
uaaaauucaucaccaaaau

SEQ ID NO: 6725 - RNA, 19 nt, artificial
  Completely synthesized
ccagcucauacucuuuccg

SEQ ID NO: 6726 - RNA, 19 nt, artificial
  Completely synthesized
cugggcucagcuaugaaag

SEQ ID NO: 6727 - RNA, 19 nt, artificial
  Completely synthesized
cgaagaaaccucauuguca

SEQ ID NO: 6728 - RNA, 19 nt, artificial
  Completely synthesized
gcagggaguauucacuagg

SEQ ID NO: 6729 - RNA, 19 nt, artificial
  Completely synthesized
cucaaaagcauuaagaaaa

SEQ ID NO: 6730 - RNA, 19 nt, artificial
  Completely synthesized
ccuccaaaguaugucaauc

SEQ ID NO: 6731 - RNA, 19 nt, artificial
  Completely synthesized
cuuucucugguguguucuc

SEQ ID NO: 6732 - RNA, 19 nt, artificial
  Completely synthesized
ugggagaaauucaccuguc

SEQ ID NO: 6733 - RNA, 19 nt, artificial
  Completely synthesized
cagucaucaaaguacaaag

SEQ ID NO: 6734 - RNA, 19 nt, artificial
  Completely synthesized
guccuguugcauaccgucu

SEQ ID NO: 6735 - RNA, 19 nt, artificial
  Completely synthesized
uaauuucuuuuuagccaga

SEQ ID NO: 6736 - RNA, 19 nt, artificial
  Completely synthesized
ucuauacuaguuuuggcua

SEQ ID NO: 6737 - RNA, 19 nt, artificial
  Completely synthesized
auuacuuauaaaguaugag

SEQ ID NO: 6738 - RNA, 19 nt, artificial
  Completely synthesized
ugaguguucuggugaugcc

SEQ ID NO: 6739 - RNA, 19 nt, artificial
  Completely synthesized
aaaugaucuaaaucuugcu

SEQ ID NO: 6740 - RNA, 19 nt, artificial
  Completely synthesized
guaaaaaugauaauuguca

SEQ ID NO: 6741 - RNA, 19 nt, artificial
  Completely synthesized
acaggcaauucuuucucug

SEQ ID NO: 6742 - RNA, 19 nt, artificial
  Completely synthesized
uauuuacacuuacacagaa

SEQ ID NO: 6743 - RNA, 19 nt, artificial
  Completely synthesized
gcaauuuuucuuuuucauc

SEQ ID NO: 6744 - RNA, 19 nt, artificial
  Completely synthesized
guucuggugaugccacacu

SEQ ID NO: 6745 - RNA, 19 nt, artificial
  Completely synthesized
aacagggagguuaaugauu

SEQ ID NO: 6746 - RNA, 19 nt, artificial
  Completely synthesized
cagggaaugggauauggag

SEQ ID NO: 6747 - RNA, 19 nt, artificial
  Completely synthesized
gcuuucagggugguuuugg

SEQ ID NO: 6748 - RNA, 19 nt, artificial
  Completely synthesized
aauaguacaaaaaaacuag

SEQ ID NO: 6749 - RNA, 19 nt, artificial
  Completely synthesized
gaauuaaugcaaguugagc

SEQ ID NO: 6750 - RNA, 19 nt, artificial
  Completely synthesized
ucgcugacugaagucaaau

SEQ ID NO: 6751 - RNA, 19 nt, artificial
  Completely synthesized
cuuaaaguagcaggugagg

SEQ ID NO: 6752 - RNA, 19 nt, artificial
  Completely synthesized
ucacugucaacugguuggg

SEQ ID NO: 6753 - RNA, 19 nt, artificial
  Completely synthesized
cugguguguucucacauug

SEQ ID NO: 6754 - RNA, 19 nt, artificial
  Completely synthesized
uuuuggcuaugauuuugca

SEQ ID NO: 6755 - RNA, 19 nt, artificial
  Completely synthesized
augguagucucaaccagcu

SEQ ID NO: 6756 - RNA, 19 nt, artificial
  Completely synthesized
aaugacauaagaacaguau

SEQ ID NO: 6757 - RNA, 19 nt, artificial
  Completely synthesized
aaaugguguccuaagaaau

SEQ ID NO: 6758 - RNA, 19 nt, artificial
  Completely synthesized
guacauagugguuaguuuu

SEQ ID NO: 6759 - RNA, 19 nt, artificial
  Completely synthesized
auacuaguuuuggcuauga

SEQ ID NO: 6760 - RNA, 19 nt, artificial
  Completely synthesized
aaccagcuugucauuuuca

SEQ ID NO: 6761 - RNA, 19 nt, artificial
  Completely synthesized
ugucaguuuggcuucugga

SEQ ID NO: 6762 - RNA, 19 nt, artificial
  Completely synthesized
aaugucugcgccaaaagcu

SEQ ID NO: 6763 - RNA, 19 nt, artificial
  Completely synthesized
uacuaguuuuggcuaugau

SEQ ID NO: 6764 - RNA, 19 nt, artificial
  Completely synthesized
acagggaaugggauaugga

SEQ ID NO: 6765 - RNA, 19 nt, artificial
  Completely synthesized
cauaccgucuaaaucaaca

SEQ ID NO: 6766 - RNA, 19 nt, artificial
  Completely synthesized
aaguucagagagugaaugg

SEQ ID NO: 6767 - RNA, 19 nt, artificial
  Completely synthesized
cugucucuucaucuaguug

SEQ ID NO: 6768 - RNA, 19 nt, artificial
  Completely synthesized
cauaagaacaguauaaaua

SEQ ID NO: 6769 - RNA, 19 nt, artificial
  Completely synthesized
aaguacauagugguuaguu

SEQ ID NO: 6770 - RNA, 19 nt, artificial
  Completely synthesized
aguuaccuacuucuuuuuc

SEQ ID NO: 6771 - RNA, 19 nt, artificial
  Completely synthesized
guuugucuuuugugaaugg

SEQ ID NO: 6772 - RNA, 19 nt, artificial
  Completely synthesized
aagaaaccucauugucauc

SEQ ID NO: 6773 - RNA, 19 nt, artificial
  Completely synthesized
augacauaagaacaguaua

SEQ ID NO: 6774 - RNA, 19 nt, artificial
  Completely synthesized
aguguucuggugaugccac

SEQ ID NO: 6775 - RNA, 19 nt, artificial
  Completely synthesized
ugguugaaagcuuugcaaa

SEQ ID NO: 6776 - RNA, 19 nt, artificial
  Completely synthesized
aaagcauuaagaaaaugug

SEQ ID NO: 6777 - RNA, 19 nt, artificial
  Completely synthesized
aucuuucaaaugaucuaaa

SEQ ID NO: 6778 - RNA, 19 nt, artificial
  Completely synthesized
agguuaaugauuuuuucua

SEQ ID NO: 6779 - RNA, 19 nt, artificial
  Completely synthesized
uggcugaauugggagaaau

SEQ ID NO: 6780 - RNA, 19 nt, artificial
  Completely synthesized
ucuuacuuuugggaacaag

SEQ ID NO: 6781 - RNA, 19 nt, artificial
  Completely synthesized
cucuaguucuacuauauuu

SEQ ID NO: 6782 - RNA, 19 nt, artificial
  Completely synthesized
agaaucacugaggccaagu

SEQ ID NO: 6783 - RNA, 19 nt, artificial
  Completely synthesized
uaacucaggaauggauaau

SEQ ID NO: 6784 - RNA, 19 nt, artificial
  Completely synthesized
aauaauccuuuauuaguac

SEQ ID NO: 6785 - RNA, 19 nt, artificial
  Completely synthesized
aaugguguccuaagaaauu

SEQ ID NO: 6786 - RNA, 19 nt, artificial
  Completely synthesized
ggaguuguucuugucuuuc

SEQ ID NO: 6787 - RNA, 19 nt, artificial
  Completely synthesized
aauguggacuacaguuacc

SEQ ID NO: 6788 - RNA, 19 nt, artificial
  Completely synthesized
gcugaauugggagaaauuc

SEQ ID NO: 6789 - RNA, 19 nt, artificial
  Completely synthesized
ucuuaacaucuggcuucuu

SEQ ID NO: 6790 - RNA, 19 nt, artificial
  Completely synthesized
aauucugagcagccacuuu

SEQ ID NO: 6791 - RNA, 19 nt, artificial
  Completely synthesized
aggccaaguagugugucuc

SEQ ID NO: 6792 - RNA, 19 nt, artificial
  Completely synthesized
ugacaaggguuguaccaua

SEQ ID NO: 6793 - RNA, 19 nt, artificial
  Completely synthesized
uccuuuuggaguuguucuu

SEQ ID NO: 6794 - RNA, 19 nt, artificial
  Completely synthesized
aggaccauucuguuugaca

SEQ ID NO: 6795 - RNA, 19 nt, artificial
  Completely synthesized
ugaugccacacugggacuu

SEQ ID NO: 6796 - RNA, 19 nt, artificial
  Completely synthesized
aaacuugcucaauguccug

SEQ ID NO: 6797 - RNA, 19 nt, artificial
  Completely synthesized
cauuuucuccuuuuucuuu

SEQ ID NO: 6798 - RNA, 19 nt, artificial
  Completely synthesized
cuccauagcuggaagauuc

SEQ ID NO: 6799 - RNA, 19 nt, artificial
  Completely synthesized
cuuuugcccuaaguucauc

SEQ ID NO: 6800 - RNA, 19 nt, artificial
  Completely synthesized
guuuuucuuaacaucuggc

SEQ ID NO: 6801 - RNA, 19 nt, artificial
  Completely synthesized
auaguacaaaaaaacuagc

SEQ ID NO: 6802 - RNA, 19 nt, artificial
  Completely synthesized
cauuucacaucacaguagg

SEQ ID NO: 6803 - RNA, 19 nt, artificial
  Completely synthesized
cuuucucuugcuccuuuug

SEQ ID NO: 6804 - RNA, 19 nt, artificial
  Completely synthesized
gggaauaucaggaacaagu

SEQ ID NO: 6805 - RNA, 19 nt, artificial
  Completely synthesized
aucaugaugagcuguggac

SEQ ID NO: 6806 - RNA, 19 nt, artificial
  Completely synthesized
aggagcuuuuaguauaaua

SEQ ID NO: 6807 - RNA, 19 nt, artificial
  Completely synthesized
aggugaaggcuuuugucau

SEQ ID NO: 6808 - RNA, 19 nt, artificial
  Completely synthesized
cacuuacacagaaacuagc

SEQ ID NO: 6809 - RNA, 19 nt, artificial
  Completely synthesized
auauaacaaaugacauaag

SEQ ID NO: 6810 - RNA, 19 nt, artificial
  Completely synthesized
ugguuaguuuugcaauaau

SEQ ID NO: 6811 - RNA, 19 nt, artificial
  Completely synthesized
ugaauauaacaaaugacau

SEQ ID NO: 6812 - RNA, 19 nt, artificial
  Completely synthesized
agauauaaggugcugaguu

SEQ ID NO: 6813 - RNA, 19 nt, artificial
  Completely synthesized
ucuguuuuuccagcucaua

SEQ ID NO: 6814 - RNA, 19 nt, artificial
  Completely synthesized
cuacaaacgggaaugucug

SEQ ID NO: 6815 - RNA, 19 nt, artificial
  Completely synthesized
cuuuuuaaaguuucguauu

SEQ ID NO: 6816 - RNA, 19 nt, artificial
  Completely synthesized
uggugacaaggguuguacc

SEQ ID NO: 6817 - RNA, 19 nt, artificial
  Completely synthesized
acuagcccaaauggugucc

SEQ ID NO: 6818 - RNA, 19 nt, artificial
  Completely synthesized
auguccuguugcauaccgu

SEQ ID NO: 6819 - RNA, 19 nt, artificial
  Completely synthesized
agcuuuugcccuaaguuca

SEQ ID NO: 6820 - RNA, 19 nt, artificial
  Completely synthesized
aauuguuuacaguuaaagu

SEQ ID NO: 6821 - RNA, 19 nt, artificial
  Completely synthesized
agcauuucacaucacagua

SEQ ID NO: 6822 - RNA, 19 nt, artificial
  Completely synthesized
gaaaauguggacuacaguu

SEQ ID NO: 6823 - RNA, 19 nt, artificial
  Completely synthesized
uaaguucaucucuugugag

SEQ ID NO: 6824 - RNA, 19 nt, artificial
  Completely synthesized
aucugaauuuaaugaguuc

SEQ ID NO: 6825 - RNA, 19 nt, artificial
  Completely synthesized
acugagccugauuaguagc

SEQ ID NO: 6826 - RNA, 19 nt, artificial
  Completely synthesized
ucaucacguagcaugcuga

SEQ ID NO: 6827 - RNA, 19 nt, artificial
  Completely synthesized
aaugccggagucagaauca

SEQ ID NO: 6828 - RNA, 19 nt, artificial
  Completely synthesized
ugcuuucagggugguuuug

SEQ ID NO: 6829 - RNA, 19 nt, artificial
  Completely synthesized
caaaguaugucaaucaaau

SEQ ID NO: 6830 - RNA, 19 nt, artificial
  Completely synthesized
auuucguugaagucaacaa

SEQ ID NO: 6831 - RNA, 19 nt, artificial
  Completely synthesized
agggaaugggauauggaga

SEQ ID NO: 6832 - RNA, 19 nt, artificial
  Completely synthesized
cuacagggaaugggauaug

SEQ ID NO: 6833 - RNA, 19 nt, artificial
  Completely synthesized
aaguagugugucuccauag

SEQ ID NO: 6834 - RNA, 19 nt, artificial
  Completely synthesized
cugcagggaguauucacua

SEQ ID NO: 6835 - RNA, 19 nt, artificial
  Completely synthesized
ucguugaagucaacaacag

SEQ ID NO: 6836 - RNA, 19 nt, artificial
  Completely synthesized
uaccuacuucuuuuuccau

SEQ ID NO: 6837 - RNA, 19 nt, artificial
  Completely synthesized
gggaacaaggaaaacauug

SEQ ID NO: 6838 - RNA, 19 nt, artificial
  Completely synthesized
aucaugcacgugagugcuc

SEQ ID NO: 6839 - RNA, 19 nt, artificial
  Completely synthesized
cugaauugggagaaauuca

SEQ ID NO: 6840 - RNA, 19 nt, artificial
  Completely synthesized
agggagguuaaugauuuuu

SEQ ID NO: 6841 - RNA, 19 nt, artificial
  Completely synthesized
cuccuuuuggaguuguucu

SEQ ID NO: 6842 - RNA, 21 nt, artificial
  Completely synthesized
gaaaaauugcucaaagaaaaa

SEQ ID NO: 6843 - RNA, 21 nt, artificial
  Completely synthesized
agaaaaaacuugaaaaggaaa

SEQ ID NO: 6844 - RNA, 21 nt, artificial
  Completely synthesized
cccuguagaaaaaaucauuaa

SEQ ID NO: 6845 - RNA, 21 nt, artificial
  Completely synthesized
gaaucaguaguuucacuuuaa

SEQ ID NO: 6846 - RNA, 21 nt, artificial
  Completely synthesized
ggaaaaacagaaaaaacuuga

SEQ ID NO: 6847 - RNA, 21 nt, artificial
  Completely synthesized
cagaauugcagaaaaagaaaa

SEQ ID NO: 6848 - RNA, 21 nt, artificial
  Completely synthesized
cagaaaaaacuugaaaaggaa

SEQ ID NO: 6849 - RNA, 21 nt, artificial
  Completely synthesized
gaaaaaggagaaaaugacaaa

SEQ ID NO: 6850 - RNA, 21 nt, artificial
  Completely synthesized
gaaaaacagaaaaaacuugaa

SEQ ID NO: 6851 - RNA, 21 nt, artificial
  Completely synthesized
gcaagauuuagaucauuugaa

SEQ ID NO: 6852 - RNA, 21 nt, artificial
  Completely synthesized
ggaaaauauaguagaacuaga

SEQ ID NO: 6853 - RNA, 21 nt, artificial
  Completely synthesized
caaagaaaaaggagaaaauga

SEQ ID NO: 6854 - RNA, 21 nt, artificial
  Completely synthesized
agccaaaacuaguauagaaaa

SEQ ID NO: 6855 - RNA, 21 nt, artificial
  Completely synthesized
cagaaaaagaaaacuggaaaa

SEQ ID NO: 6856 - RNA, 21 nt, artificial
  Completely synthesized
agaaaaaggagaaaaugacaa

SEQ ID NO: 6857 - RNA, 21 nt, artificial
  Completely synthesized
caagauuuagaucauuugaaa

SEQ ID NO: 6858 - RNA, 21 nt, artificial
  Completely synthesized
ccaaaacuaguauagaaaaua

SEQ ID NO: 6859 - RNA, 21 nt, artificial
  Completely synthesized
agaaaaauugcucaaagaaaa

SEQ ID NO: 6860 - RNA, 21 nt, artificial
  Completely synthesized
aaauacuguauggacaaaaaa

SEQ ID NO: 6861 - RNA, 21 nt, artificial
  Completely synthesized
ucagaauugcagaaaaagaaa

SEQ ID NO: 6862 - RNA, 21 nt, artificial
  Completely synthesized
agauuuuggugaugaauuuua

SEQ ID NO: 6863 - RNA, 21 nt, artificial
  Completely synthesized
aagaaaaauugcucaaagaaa

SEQ ID NO: 6864 - RNA, 21 nt, artificial
  Completely synthesized
aaagaaaaauugcucaaagaa

SEQ ID NO: 6865 - RNA, 21 nt, artificial
  Completely synthesized
guaaguguaaauacuacaaaa

SEQ ID NO: 6866 - RNA, 21 nt, artificial
  Completely synthesized
ccacuauguacuuuuuuauaa

SEQ ID NO: 6867 - RNA, 21 nt, artificial
  Completely synthesized
ggacaaaaaauggcauuuuuu

SEQ ID NO: 6868 - RNA, 21 nt, artificial
  Completely synthesized
gaauuuuauucugcuuucaua

SEQ ID NO: 6869 - RNA, 21 nt, artificial
  Completely synthesized
ucacaaaagacaaacauucaa

SEQ ID NO: 6870 - RNA, 21 nt, artificial
  Completely synthesized
uuauaaauacuguauggacaa

SEQ ID NO: 6871 - RNA, 21 nt, artificial
  Completely synthesized
ugaguuacagugucuuaauau

SEQ ID NO: 6872 - RNA, 21 nt, artificial
  Completely synthesized
cuggaaaauauaguagaacua

SEQ ID NO: 6873 - RNA, 21 nt, artificial
  Completely synthesized
gcuaaaaagaaauuauugcaa

SEQ ID NO: 6874 - RNA, 21 nt, artificial
  Completely synthesized
gaaaaagaaaacuggaaaaua

SEQ ID NO: 6875 - RNA, 21 nt, artificial
  Completely synthesized
gucuuaauauugaaaaugaca

SEQ ID NO: 6876 - RNA, 21 nt, artificial
  Completely synthesized
gugaaaugcucauacuuuaua

SEQ ID NO: 6877 - RNA, 21 nt, artificial
  Completely synthesized
gaucauuugaaagaugaaaaa

SEQ ID NO: 6878 - RNA, 21 nt, artificial
  Completely synthesized
gccaaaacuaguauagaaaau

SEQ ID NO: 6879 - RNA, 21 nt, artificial
  Completely synthesized
uacagugucuuaauauugaaa

SEQ ID NO: 6880 - RNA, 21 nt, artificial
  Completely synthesized
aaacuugaaaaggaaagacaa

SEQ ID NO: 6881 - RNA, 21 nt, artificial
  Completely synthesized
aauggaaaaagaaguagguaa

SEQ ID NO: 6882 - RNA, 21 nt, artificial
  Completely synthesized
cauuugaaagaugaaaaagaa

SEQ ID NO: 6883 - RNA, 21 nt, artificial
  Completely synthesized
aaaagaaaaauugcucaaaga

SEQ ID NO: 6884 - RNA, 21 nt, artificial
  Completely synthesized
agaucauuugaaagaugaaaa

SEQ ID NO: 6885 - RNA, 21 nt, artificial
  Completely synthesized
cauucacaaaagacaaacauu

SEQ ID NO: 6886 - RNA, 21 nt, artificial
  Completely synthesized
agauuuagaucauuugaaaga

SEQ ID NO: 6887 - RNA, 21 nt, artificial
  Completely synthesized
guaguuucacuuuaacuguaa

SEQ ID NO: 6888 - RNA, 21 nt, artificial
  Completely synthesized
aaaucauagccaaaacuagua

SEQ ID NO: 6889 - RNA, 21 nt, artificial
  Completely synthesized
acagugucuuaauauugaaaa

SEQ ID NO: 6890 - RNA, 21 nt, artificial
  Completely synthesized
aaaacuggaaaauauaguaga

SEQ ID NO: 6891 - RNA, 21 nt, artificial
  Completely synthesized
gugucuuaauauugaaaauga

SEQ ID NO: 6892 - RNA, 21 nt, artificial
  Completely synthesized
uagccaaaacuaguauagaaa

SEQ ID NO: 6893 - RNA, 21 nt, artificial
  Completely synthesized
augugaaaugcucauacuuua

SEQ ID NO: 6894 - RNA, 21 nt, artificial
  Completely synthesized
uuacagugucuuaauauugaa

SEQ ID NO: 6895 - RNA, 21 nt, artificial
  Completely synthesized
ugaaaaagaaaaauugcucaa

SEQ ID NO: 6896 - RNA, 21 nt, artificial
  Completely synthesized
acagaaaaaacuugaaaagga

SEQ ID NO: 6897 - RNA, 21 nt, artificial
  Completely synthesized
cuggaaaaacagaaaaaacuu

SEQ ID NO: 6898 - RNA, 21 nt, artificial
  Completely synthesized
ggcuaaaaagaaauuauugca

SEQ ID NO: 6899 - RNA, 21 nt, artificial
  Completely synthesized
cagauguuaagaaaaacuaga

SEQ ID NO: 6900 - RNA, 21 nt, artificial
  Completely synthesized
aauacuguauggacaaaaaau

SEQ ID NO: 6901 - RNA, 21 nt, artificial
  Completely synthesized
auaaauacuguauggacaaaa

SEQ ID NO: 6902 - RNA, 21 nt, artificial
  Completely synthesized
ugaaaugcucauacuuuauaa

SEQ ID NO: 6903 - RNA, 21 nt, artificial
  Completely synthesized
uuaagagcugguacuaauaaa

SEQ ID NO: 6904 - RNA, 21 nt, artificial
  Completely synthesized
gaaaaagaaaaauugcucaaa

SEQ ID NO: 6905 - RNA, 21 nt, artificial
  Completely synthesized
gauuuuggugaugaauuuuau

SEQ ID NO: 6906 - RNA, 21 nt, artificial
  Completely synthesized
aagaaaaaggagaaaaugaca

SEQ ID NO: 6907 - RNA, 21 nt, artificial
  Completely synthesized
agugaacucauuaaauucaga

SEQ ID NO: 6908 - RNA, 21 nt, artificial
  Completely synthesized
cagugucuuaauauugaaaau

SEQ ID NO: 6909 - RNA, 21 nt, artificial
  Completely synthesized
gaguuacagugucuuaauauu

SEQ ID NO: 6910 - RNA, 21 nt, artificial
  Completely synthesized
guuacagugucuuaauauuga

SEQ ID NO: 6911 - RNA, 21 nt, artificial
  Completely synthesized
gaaacuuuaaaaagcauugga

SEQ ID NO: 6912 - RNA, 21 nt, artificial
  Completely synthesized
ucauuugaaagaugaaaaaga

SEQ ID NO: 6913 - RNA, 21 nt, artificial
  Completely synthesized
aguaguuucacuuuaacugua

SEQ ID NO: 6914 - RNA, 21 nt, artificial
  Completely synthesized
gcuaguuuuuuuguacuauua

SEQ ID NO: 6915 - RNA, 21 nt, artificial
  Completely synthesized
ugcucauacuuuauaaguaau

SEQ ID NO: 6916 - RNA, 21 nt, artificial
  Completely synthesized
ccacauuuucuuaaugcuuuu

SEQ ID NO: 6917 - RNA, 21 nt, artificial
  Completely synthesized
gacaaaaaauggcauuuuuua

SEQ ID NO: 6918 - RNA, 21 nt, artificial
  Completely synthesized
gaaaaaacuugaaaaggaaag

SEQ ID NO: 6919 - RNA, 21 nt, artificial
  Completely synthesized
auacgaaacuuuaaaaagcau

SEQ ID NO: 6920 - RNA, 21 nt, artificial
  Completely synthesized
cuaguauagaaaauaauacga

SEQ ID NO: 6921 - RNA, 21 nt, artificial
  Completely synthesized
gauuuauaugaugauaugaca

SEQ ID NO: 6922 - RNA, 21 nt, artificial
  Completely synthesized
auuugauugacauacuuugga

SEQ ID NO: 6923 - RNA, 21 nt, artificial
  Completely synthesized
aguuucuguguaaguguaaau

SEQ ID NO: 6924 - RNA, 21 nt, artificial
  Completely synthesized
agaaaacuggaaaauauagua

SEQ ID NO: 6925 - RNA, 21 nt, artificial
  Completely synthesized
aaaacuugaaaaggaaagaca

SEQ ID NO: 6926 - RNA, 21 nt, artificial
  Completely synthesized
ucuguguaaguguaaauacua

SEQ ID NO: 6927 - RNA, 21 nt, artificial
  Completely synthesized
ugugaaaugcucauacuuuau

SEQ ID NO: 6928 - RNA, 21 nt, artificial
  Completely synthesized
agaugaaaaagaaaaauugcu

SEQ ID NO: 6929 - RNA, 21 nt, artificial
  Completely synthesized
agagcaagauuuagaucauuu

SEQ ID NO: 6930 - RNA, 21 nt, artificial
  Completely synthesized
aguaauucuaugcaaaaucau

SEQ ID NO: 6931 - RNA, 21 nt, artificial
  Completely synthesized
uaugcaaaaucauagccaaaa

SEQ ID NO: 6932 - RNA, 21 nt, artificial
  Completely synthesized
uaaauacuguauggacaaaaa

SEQ ID NO: 6933 - RNA, 21 nt, artificial
  Completely synthesized
agaaauuauugcaaaacuaac

SEQ ID NO: 6934 - RNA, 21 nt, artificial
  Completely synthesized
agauguuaagaaaaacuagau

SEQ ID NO: 6935 - RNA, 21 nt, artificial
  Completely synthesized
uggauuugauugacauacuuu

SEQ ID NO: 6936 - RNA, 21 nt, artificial
  Completely synthesized
uaagaaaaacuagauuuagga

SEQ ID NO: 6937 - RNA, 21 nt, artificial
  Completely synthesized
uguucuuaugucauuuguuau

SEQ ID NO: 6938 - RNA, 21 nt, artificial
  Completely synthesized
aaagaaaacuggaaaauauag

SEQ ID NO: 6939 - RNA, 21 nt, artificial
  Completely synthesized
uauaaauacuguauggacaaa

SEQ ID NO: 6940 - RNA, 21 nt, artificial
  Completely synthesized
aaacuggaaaauauaguagaa

SEQ ID NO: 6941 - RNA, 21 nt, artificial
  Completely synthesized
aucccauucccuguagaaaaa

SEQ ID NO: 6942 - RNA, 21 nt, artificial
  Completely synthesized
gcucauacuuuauaaguaauu

SEQ ID NO: 6943 - RNA, 21 nt, artificial
  Completely synthesized
gguacuaauaaaggauuauua

SEQ ID NO: 6944 - RNA, 21 nt, artificial
  Completely synthesized
uuuagaucauuugaaagauga

SEQ ID NO: 6945 - RNA, 21 nt, artificial
  Completely synthesized
uuuuaagagcugguacuaaua

SEQ ID NO: 6946 - RNA, 21 nt, artificial
  Completely synthesized
uguguaaguguaaauacuaca

SEQ ID NO: 6947 - RNA, 21 nt, artificial
  Completely synthesized
cuauuauacuaaaagcuccua

SEQ ID NO: 6948 - RNA, 21 nt, artificial
  Completely synthesized
guucuuaugucauuuguuaua

SEQ ID NO: 6949 - RNA, 21 nt, artificial
  Completely synthesized
cucaaagaaaaaggagaaaau

SEQ ID NO: 6950 - RNA, 21 nt, artificial
  Completely synthesized
cagauuuuggugaugaauuuu

SEQ ID NO: 6951 - RNA, 21 nt, artificial
  Completely synthesized
ugaugaauuuuauucugcuuu

SEQ ID NO: 6952 - RNA, 21 nt, artificial
  Completely synthesized
ugacagugaacucauuaaauu

SEQ ID NO: 6953 - RNA, 21 nt, artificial
  Completely synthesized
gaaaauauaguagaacuagag

SEQ ID NO: 6954 - RNA, 21 nt, artificial
  Completely synthesized
guguaaguguaaauacuacaa

SEQ ID NO: 6955 - RNA, 21 nt, artificial
  Completely synthesized
aaaaaggagaaaaugacaaaa

SEQ ID NO: 6956 - RNA, 21 nt, artificial
  Completely synthesized
uuagaucauuugaaagaugaa

SEQ ID NO: 6957 - RNA, 21 nt, artificial
  Completely synthesized
gugaugaagauggaaaaccuu

SEQ ID NO: 6958 - RNA, 21 nt, artificial
  Completely synthesized
aauacgaaacuuuaaaaagca

SEQ ID NO: 6959 - RNA, 21 nt, artificial
  Completely synthesized
uaguuucuguguaaguguaaa

SEQ ID NO: 6960 - RNA, 21 nt, artificial
  Completely synthesized
uguaguccacauuuucuuaau

SEQ ID NO: 6961 - RNA, 21 nt, artificial
  Completely synthesized
uguaaguguaaauacuacaaa

SEQ ID NO: 6962 - RNA, 21 nt, artificial
  Completely synthesized
uacgaaacuuuaaaaagcauu

SEQ ID NO: 6963 - RNA, 21 nt, artificial
  Completely synthesized
agaaaaagaaaacuggaaaau

SEQ ID NO: 6964 - RNA, 21 nt, artificial
  Completely synthesized
uaaccacuauguacuuuuuua

SEQ ID NO: 6965 - RNA, 21 nt, artificial
  Completely synthesized
guuucuguguaaguguaaaua

SEQ ID NO: 6966 - RNA, 21 nt, artificial
  Completely synthesized
gacaauuaucauuuuuacuca

SEQ ID NO: 6967 - RNA, 21 nt, artificial
  Completely synthesized
ccuguagaaaaaaucauuaac

SEQ ID NO: 6968 - RNA, 21 nt, artificial
  Completely synthesized
ucccuguagaaaaaaucauua

SEQ ID NO: 6969 - RNA, 21 nt, artificial
  Completely synthesized
aaauauaguagaacuagagca

SEQ ID NO: 6970 - RNA, 21 nt, artificial
  Completely synthesized
aagaaaacuggaaaauauagu

SEQ ID NO: 6971 - RNA, 21 nt, artificial
  Completely synthesized
aacuaaccacuauguacuuuu

SEQ ID NO: 6972 - RNA, 21 nt, artificial
  Completely synthesized
guaauucuaugcaaaaucaua

SEQ ID NO: 6973 - RNA, 21 nt, artificial
  Completely synthesized
aauguuuuccuuguucccaaa

SEQ ID NO: 6974 - RNA, 21 nt, artificial
  Completely synthesized
acaucuggcuaaaaagaaauu

SEQ ID NO: 6975 - RNA, 21 nt, artificial
  Completely synthesized
caaaaucauagccaaaacuag

SEQ ID NO: 6976 - RNA, 21 nt, artificial
  Completely synthesized
accacuauguacuuuuuuaua

SEQ ID NO: 6977 - RNA, 21 nt, artificial
  Completely synthesized
cuaaccacuauguacuuuuuu

SEQ ID NO: 6978 - RNA, 21 nt, artificial
  Completely synthesized
gaauuucucccaauucagcca

SEQ ID NO: 6979 - RNA, 21 nt, artificial
  Completely synthesized
cuacuuggccucagugauucu

SEQ ID NO: 6980 - RNA, 21 nt, artificial
  Completely synthesized
aauauaguagaacuagagcaa

SEQ ID NO: 6981 - RNA, 21 nt, artificial
  Completely synthesized
agucagcgacggaaagaguau

SEQ ID NO: 6982 - RNA, 21 nt, artificial
  Completely synthesized
aaauuauugcaaaacuaacca

SEQ ID NO: 6983 - RNA, 21 nt, artificial
  Completely synthesized
cauagccaaaacuaguauaga

SEQ ID NO: 6984 - RNA, 21 nt, artificial
  Completely synthesized
acuggaaaauauaguagaacu

SEQ ID NO: 6985 - RNA, 21 nt, artificial
  Completely synthesized
uucacaaaagacaaacauuca

SEQ ID NO: 6986 - RNA, 21 nt, artificial
  Completely synthesized
cuaaaagcuccuacugugaug

SEQ ID NO: 6987 - RNA, 21 nt, artificial
  Completely synthesized
uggaaaaacagaaaaaacuug

SEQ ID NO: 6988 - RNA, 21 nt, artificial
  Completely synthesized
augcucauacuuuauaaguaa

SEQ ID NO: 6989 - RNA, 21 nt, artificial
  Completely synthesized
uguaaacaauuucuuaggaca

SEQ ID NO: 6990 - RNA, 21 nt, artificial
  Completely synthesized
ugaauuuuauucugcuuucau

SEQ ID NO: 6991 - RNA, 21 nt, artificial
  Completely synthesized
cuguucuuaugucauuuguua

SEQ ID NO: 6992 - RNA, 21 nt, artificial
  Completely synthesized
uaguuucacuuuaacuguaaa

SEQ ID NO: 6993 - RNA, 21 nt, artificial
  Completely synthesized
uugacagugaacucauuaaau

SEQ ID NO: 6994 - RNA, 21 nt, artificial
  Completely synthesized
agagcaguucaaugaagcuca

SEQ ID NO: 6995 - RNA, 21 nt, artificial
  Completely synthesized
cagaaguugacaauuaucauu

SEQ ID NO: 6996 - RNA, 21 nt, artificial
  Completely synthesized
acucauuaaauucagaugcca

SEQ ID NO: 6997 - RNA, 21 nt, artificial
  Completely synthesized
gaaguugacaauuaucauuuu

SEQ ID NO: 6998 - RNA, 21 nt, artificial
  Completely synthesized
ccaaaaguaagaagccagaug

SEQ ID NO: 6999 - RNA, 21 nt, artificial
  Completely synthesized
ucaaugaagcucaacuugcau

SEQ ID NO: 7000 - RNA, 21 nt, artificial
  Completely synthesized
ucacuuuaacuguaaacaauu

SEQ ID NO: 7001 - RNA, 21 nt, artificial
  Completely synthesized
cugguacuaauaaaggauuau

SEQ ID NO: 7002 - RNA, 21 nt, artificial
  Completely synthesized
cuuggccucagugauucugaa

SEQ ID NO: 7003 - RNA, 21 nt, artificial
  Completely synthesized
acagauuuuggugaugaauuu

SEQ ID NO: 7004 - RNA, 21 nt, artificial
  Completely synthesized
guguaaauacuacaaaaacuu

SEQ ID NO: 7005 - RNA, 21 nt, artificial
  Completely synthesized
ugaaucaguaguuucacuuua

SEQ ID NO: 7006 - RNA, 21 nt, artificial
  Completely synthesized
agaugacaaugagguuucuuc

SEQ ID NO: 7007 - RNA, 21 nt, artificial
  Completely synthesized
guaucagcaacagcaugcccu

SEQ ID NO: 7008 - RNA, 21 nt, artificial
  Completely synthesized
cuuuauaaguaauucuaugca

SEQ ID NO: 7009 - RNA, 21 nt, artificial
  Completely synthesized
gacauacuuuggaggcaagau

SEQ ID NO: 7010 - RNA, 21 nt, artificial
  Completely synthesized
aaagaaaaaggagaaaaugac

SEQ ID NO: 7011 - RNA, 21 nt, artificial
  Completely synthesized
caucuggcuaaaaagaaauua

SEQ ID NO: 7012 - RNA, 21 nt, artificial
  Completely synthesized
gugaacucauuaaauucagau

SEQ ID NO: 7013 - RNA, 21 nt, artificial
  Completely synthesized
uguugaaucaguaguuucacu

SEQ ID NO: 7014 - RNA, 21 nt, artificial
  Completely synthesized
aaugacaaaagccuucaccua

SEQ ID NO: 7015 - RNA, 21 nt, artificial
  Completely synthesized
gaaagaauugccuguaagucc

SEQ ID NO: 7016 - RNA, 21 nt, artificial
  Completely synthesized
gauggaaaaccuuauucuccu

SEQ ID NO: 7017 - RNA, 21 nt, artificial
  Completely synthesized
acuauuauacuaaaagcuccu

SEQ ID NO: 7018 - RNA, 21 nt, artificial
  Completely synthesized
aaaaagaaguagguaacugua

SEQ ID NO: 7019 - RNA, 21 nt, artificial
  Completely synthesized
auagccaaaacuaguauagaa

SEQ ID NO: 7020 - RNA, 21 nt, artificial
  Completely synthesized
cuucagucagcgacggaaaga

SEQ ID NO: 7021 - RNA, 21 nt, artificial
  Completely synthesized
aaugaagcucaacuugcauua

SEQ ID NO: 7022 - RNA, 21 nt, artificial
  Completely synthesized
aucauagccaaaacuaguaua

SEQ ID NO: 7023 - RNA, 21 nt, artificial
  Completely synthesized
aagauuuagaucauuugaaag

SEQ ID NO: 7024 - RNA, 21 nt, artificial
  Completely synthesized
caacccuugucaccaucucag

SEQ ID NO: 7025 - RNA, 21 nt, artificial
  Completely synthesized
ucuccauaucccauucccugu

SEQ ID NO: 7026 - RNA, 21 nt, artificial
  Completely synthesized
uaaucaggcucagucaccuga

SEQ ID NO: 7027 - RNA, 21 nt, artificial
  Completely synthesized
caaacauucaagccgcuugga

SEQ ID NO: 7028 - RNA, 21 nt, artificial
  Completely synthesized
agaaguugacaauuaucauuu

SEQ ID NO: 7029 - RNA, 21 nt, artificial
  Completely synthesized
ugaaguggaagagcuagauag

SEQ ID NO: 7030 - RNA, 21 nt, artificial
  Completely synthesized
ucaguauguugaaucaguagu

SEQ ID NO: 7031 - RNA, 21 nt, artificial
  Completely synthesized
guagaaaaaaucauuaaccuc

SEQ ID NO: 7032 - RNA, 21 nt, artificial
  Completely synthesized
aaugguccuaaaacaccagua

SEQ ID NO: 7033 - RNA, 21 nt, artificial
  Completely synthesized
uucugagcuaguuuuuuugua

SEQ ID NO: 7034 - RNA, 21 nt, artificial
  Completely synthesized
ucuggcuaaaaagaaauuauu

SEQ ID NO: 7035 - RNA, 21 nt, artificial
  Completely synthesized
auuuauacuguucuuauguca

SEQ ID NO: 7036 - RNA, 21 nt, artificial
  Completely synthesized
agccuuuuucgcucaguuaca

SEQ ID NO: 7037 - RNA, 21 nt, artificial
  Completely synthesized
aaguguaaauacuacaaaaac

SEQ ID NO: 7038 - RNA, 21 nt, artificial
  Completely synthesized
aaucauagccaaaacuaguau

SEQ ID NO: 7039 - RNA, 21 nt, artificial
  Completely synthesized
agcuaguuuuuuuguacuauu

SEQ ID NO: 7040 - RNA, 21 nt, artificial
  Completely synthesized
ccauucccuguagaaaaaauc

SEQ ID NO: 7041 - RNA, 21 nt, artificial
  Completely synthesized
caauuaucauuuuuacucauc

SEQ ID NO: 7042 - RNA, 21 nt, artificial
  Completely synthesized
uuuucuuaaugcuuuugagga

SEQ ID NO: 7043 - RNA, 21 nt, artificial
  Completely synthesized
uauugcaaaacuaaccacuau

SEQ ID NO: 7044 - RNA, 21 nt, artificial
  Completely synthesized
agcaugcuacgugaugaagau

SEQ ID NO: 7045 - RNA, 21 nt, artificial
  Completely synthesized
gauuuagaucauuugaaagau

SEQ ID NO: 7046 - RNA, 21 nt, artificial
  Completely synthesized
ugagcuaguuuuuuuguacua

SEQ ID NO: 7047 - RNA, 21 nt, artificial
  Completely synthesized
auucccguuuguagaugacaa

SEQ ID NO: 7048 - RNA, 21 nt, artificial
  Completely synthesized
agcaagauuuagaucauuuga

SEQ ID NO: 7049 - RNA, 21 nt, artificial
  Completely synthesized
caugcuacgugaugaagaugg

SEQ ID NO: 7050 - RNA, 21 nt, artificial
  Completely synthesized
ucuauacccucaauggaaaaa

SEQ ID NO: 7051 - RNA, 21 nt, artificial
  Completely synthesized
aacacaagucccaguguggca

SEQ ID NO: 7052 - RNA, 21 nt, artificial
  Completely synthesized
aaaacuaaccacuauguacuu

SEQ ID NO: 7053 - RNA, 21 nt, artificial
  Completely synthesized
uguagaaaaaaucauuaaccu

SEQ ID NO: 7054 - RNA, 21 nt, artificial
  Completely synthesized
aaaaggagaaaaugacaaaag

SEQ ID NO: 7055 - RNA, 21 nt, artificial
  Completely synthesized
aucacuuugcaaagcuuucaa

SEQ ID NO: 7056 - RNA, 21 nt, artificial
  Completely synthesized
aaacuagauuuaggaggauuu

SEQ ID NO: 7057 - RNA, 21 nt, artificial
  Completely synthesized
aaaagcucuccauaucccauu

SEQ ID NO: 7058 - RNA, 21 nt, artificial
  Completely synthesized
gugaugaauuuuauucugcuu

SEQ ID NO: 7059 - RNA, 21 nt, artificial
  Completely synthesized
auguuucugaucuaucacuuu

SEQ ID NO: 7060 - RNA, 21 nt, artificial
  Completely synthesized
ucccaaaucagaugcuuugua

SEQ ID NO: 7061 - RNA, 21 nt, artificial
  Completely synthesized
ccuaaaacaccaguacauucu

SEQ ID NO: 7062 - RNA, 21 nt, artificial
  Completely synthesized
aaaaucauagccaaaacuagu

SEQ ID NO: 7063 - RNA, 21 nt, artificial
  Completely synthesized
agcuauuauccauuccugagu

SEQ ID NO: 7064 - RNA, 21 nt, artificial
  Completely synthesized
aaaaaacuugaaaaggaaaga

SEQ ID NO: 7065 - RNA, 21 nt, artificial
  Completely synthesized
caaagcuuucaaccaaaacca

SEQ ID NO: 7066 - RNA, 21 nt, artificial
  Completely synthesized
aucaguaguuucacuuuaacu

SEQ ID NO: 7067 - RNA, 21 nt, artificial
  Completely synthesized
aaccaguggaucugccaacua

SEQ ID NO: 7068 - RNA, 21 nt, artificial
  Completely synthesized
cuagauuuaggaggauuugac

SEQ ID NO: 7069 - RNA, 21 nt, artificial
  Completely synthesized
cuaaaacaccaguacauucuu

SEQ ID NO: 7070 - RNA, 21 nt, artificial
  Completely synthesized
aaugcucauacuuuauaagua

SEQ ID NO: 7071 - RNA, 21 nt, artificial
  Completely synthesized
gaaaccaguggaucugccaac

SEQ ID NO: 7072 - RNA, 21 nt, artificial
  Completely synthesized
caaugugagaacacaccagag

SEQ ID NO: 7073 - RNA, 21 nt, artificial
  Completely synthesized
acagugaacucauuaaauuca

SEQ ID NO: 7074 - RNA, 21 nt, artificial
  Completely synthesized
agacaaacauucaagccgcuu

SEQ ID NO: 7075 - RNA, 21 nt, artificial
  Completely synthesized
uuauucugcuuucauagcuga

SEQ ID NO: 7076 - RNA, 21 nt, artificial
  Completely synthesized
agcccagucuucauugcuacu

SEQ ID NO: 7077 - RNA, 21 nt, artificial
  Completely synthesized
caaaucagaugcuuuguacuu

SEQ ID NO: 7078 - RNA, 21 nt, artificial
  Completely synthesized
agcaguucaaugaagcucaac

SEQ ID NO: 7079 - RNA, 21 nt, artificial
  Completely synthesized
uauacuaaaagcuccuacugu

SEQ ID NO: 7080 - RNA, 21 nt, artificial
  Completely synthesized
aaaaagcauuggagugucagu

SEQ ID NO: 7081 - RNA, 21 nt, artificial
  Completely synthesized
aaacaagagauggcaauguuu

SEQ ID NO: 7082 - RNA, 21 nt, artificial
  Completely synthesized
aguuacaacuagaugaagaga

SEQ ID NO: 7083 - RNA, 21 nt, artificial
  Completely synthesized
agaauugcagaaaaagaaaac

SEQ ID NO: 7084 - RNA, 21 nt, artificial
  Completely synthesized
uuauugcaaaacuaaccacua

SEQ ID NO: 7085 - RNA, 21 nt, artificial
  Completely synthesized
ugucauuuguuauauucauag

SEQ ID NO: 7086 - RNA, 21 nt, artificial
  Completely synthesized
ugacuucagucagcgacggaa

SEQ ID NO: 7087 - RNA, 21 nt, artificial
  Completely synthesized
uggacaaaaaauggcauuuuu

SEQ ID NO: 7088 - RNA, 21 nt, artificial
  Completely synthesized
gaaaacuggaaaauauaguag

SEQ ID NO: 7089 - RNA, 21 nt, artificial
  Completely synthesized
auugacauacuuuggaggcaa

SEQ ID NO: 7090 - RNA, 21 nt, artificial
  Completely synthesized
aagauauagaucuuggaguaa

SEQ ID NO: 7091 - RNA, 21 nt, artificial
  Completely synthesized
cuggcuaaaaagaaauuauug

SEQ ID NO: 7092 - RNA, 21 nt, artificial
  Completely synthesized
cacuuuaacuguaaacaauuu

SEQ ID NO: 7093 - RNA, 21 nt, artificial
  Completely synthesized
aaaagccuucaccuacugaaa

SEQ ID NO: 7094 - RNA, 21 nt, artificial
  Completely synthesized
ccaaaucagaugcuuuguacu

SEQ ID NO: 7095 - RNA, 21 nt, artificial
  Completely synthesized
auuugggcuaguuucugugua

SEQ ID NO: 7096 - RNA, 21 nt, artificial
  Completely synthesized
cccacauucccaaaucagaug

SEQ ID NO: 7097 - RNA, 21 nt, artificial
  Completely synthesized
aagaguaugagcuggaaaaac

SEQ ID NO: 7098 - RNA, 21 nt, artificial
  Completely synthesized
cacuacuuggccucagugauu

SEQ ID NO: 7099 - RNA, 21 nt, artificial
  Completely synthesized
ugaugauaugacaucuggcua

SEQ ID NO: 7100 - RNA, 21 nt, artificial
  Completely synthesized
ggaaucuuccagcuauggaga

SEQ ID NO: 7101 - RNA, 21 nt, artificial
  Completely synthesized
acaagucccaguguggcauca

SEQ ID NO: 7102 - RNA, 21 nt, artificial
  Completely synthesized
gcaguucaaugaagcucaacu

SEQ ID NO: 7103 - RNA, 21 nt, artificial
  Completely synthesized
gucauuuguuauauucauaga

SEQ ID NO: 7104 - RNA, 21 nt, artificial
  Completely synthesized
uccacauuuucuuaaugcuuu

SEQ ID NO: 7105 - RNA, 21 nt, artificial
  Completely synthesized
acuguucuuaugucauuuguu

SEQ ID NO: 7106 - RNA, 21 nt, artificial
  Completely synthesized
uccaaagagcaguucaaugaa

SEQ ID NO: 7107 - RNA, 21 nt, artificial
  Completely synthesized
ucaguuacaacuagaugaaga

SEQ ID NO: 7108 - RNA, 21 nt, artificial
  Completely synthesized
aauuuuauucugcuuucauag

SEQ ID NO: 7109 - RNA, 21 nt, artificial
  Completely synthesized
guaacuguaguccacauuuuc

SEQ ID NO: 7110 - RNA, 21 nt, artificial
  Completely synthesized
uggaaaauauaguagaacuag

SEQ ID NO: 7111 - RNA, 21 nt, artificial
  Completely synthesized
cuuaauauugaaaaugacaag

SEQ ID NO: 7112 - RNA, 21 nt, artificial
  Completely synthesized
uauccauuccugaguuacagu

SEQ ID NO: 7113 - RNA, 21 nt, artificial
  Completely synthesized
uaaaaagcauuggagugucag

SEQ ID NO: 7114 - RNA, 21 nt, artificial
  Completely synthesized
guuacaacuagaugaagagac

SEQ ID NO: 7115 - RNA, 21 nt, artificial
  Completely synthesized
ugacaaaagccuucaccuacu

SEQ ID NO: 7116 - RNA, 21 nt, artificial
  Completely synthesized
gauguuaagaaaaacuagauu

SEQ ID NO: 7117 - RNA, 21 nt, artificial
  Completely synthesized
caaccaguugacagugaacuc

SEQ ID NO: 7118 - RNA, 21 nt, artificial
  Completely synthesized
aucuggcuaaaaagaaauuau

SEQ ID NO: 7119 - RNA, 21 nt, artificial
  Completely synthesized
guuuucagcaugcuacgugau

SEQ ID NO: 7120 - RNA, 21 nt, artificial
  Completely synthesized
ucuucauugcuacuaaucagg

SEQ ID NO: 7121 - RNA, 21 nt, artificial
  Completely synthesized
guacuuugaugacugcaugca

SEQ ID NO: 7122 - RNA, 21 nt, artificial
  Completely synthesized
aaccacuauguacuuuuuuau

SEQ ID NO: 7123 - RNA, 21 nt, artificial
  Completely synthesized
acagaaguugacaauuaucau

SEQ ID NO: 7124 - RNA, 21 nt, artificial
  Completely synthesized
uagaucauuugaaagaugaaa

SEQ ID NO: 7125 - RNA, 21 nt, artificial
  Completely synthesized
aguguaaauacuacaaaaacu

SEQ ID NO: 7126 - RNA, 21 nt, artificial
  Completely synthesized
aacaagagauggcaauguuuu

SEQ ID NO: 7127 - RNA, 21 nt, artificial
  Completely synthesized
agauuuauaugaugauaugac

SEQ ID NO: 7128 - RNA, 21 nt, artificial
  Completely synthesized
ggauaugguacaacccuuguc

SEQ ID NO: 7129 - RNA, 21 nt, artificial
  Completely synthesized
gcauuggagugucaguauguu

SEQ ID NO: 7130 - RNA, 21 nt, artificial
  Completely synthesized
aguuacagugucuuaauauug

SEQ ID NO: 7131 - RNA, 21 nt, artificial
  Completely synthesized
uuuuccuuguucccaaaagua

SEQ ID NO: 7132 - RNA, 21 nt, artificial
  Completely synthesized
accuuauucuccuagugaaua

SEQ ID NO: 7133 - RNA, 21 nt, artificial
  Completely synthesized
cgugaugaagauggaaaaccu

SEQ ID NO: 7134 - RNA, 21 nt, artificial
  Completely synthesized
caugcccucaccugcuacuuu

SEQ ID NO: 7135 - RNA, 21 nt, artificial
  Completely synthesized
aaaaauugcucaaagaaaaag

SEQ ID NO: 7136 - RNA, 21 nt, artificial
  Completely synthesized
gaaucuuccagcuauggagac

SEQ ID NO: 7137 - RNA, 21 nt, artificial
  Completely synthesized
uggugaugaauuuuauucugc

SEQ ID NO: 7138 - RNA, 21 nt, artificial
  Completely synthesized
cuuccagcuauggagacacac

SEQ ID NO: 7139 - RNA, 21 nt, artificial
  Completely synthesized
aaaaugacaagcugguugaga

SEQ ID NO: 7140 - RNA, 21 nt, artificial
  Completely synthesized
acuuugcaaagcuuucaacca

SEQ ID NO: 7141 - RNA, 21 nt, artificial
  Completely synthesized
aaagccuuuuucgcucaguua

SEQ ID NO: 7142 - RNA, 21 nt, artificial
  Completely synthesized
augacaagcugguugagacua

SEQ ID NO: 7143 - RNA, 21 nt, artificial
  Completely synthesized
cuuuaacuguaaacaauuucu

SEQ ID NO: 7144 - RNA, 21 nt, artificial
  Completely synthesized
uuuauacuguucuuaugucau

SEQ ID NO: 7145 - RNA, 21 nt, artificial
  Completely synthesized
aaagcuccuacugugauguga

SEQ ID NO: 7146 - RNA, 21 nt, artificial
  Completely synthesized
gauuuaggaggauuugaccuu

SEQ ID NO: 7147 - RNA, 21 nt, artificial
  Completely synthesized
agauauagaucuuggaguaag

SEQ ID NO: 7148 - RNA, 21 nt, artificial
  Completely synthesized
agagcccagucuucauugcua

SEQ ID NO: 7149 - RNA, 21 nt, artificial
  Completely synthesized
uccagaagccaaacugacaga

SEQ ID NO: 7150 - RNA, 21 nt, artificial
  Completely synthesized
guccacauuuucuuaaugcuu

SEQ ID NO: 7151 - RNA, 21 nt, artificial
  Completely synthesized
auagaucuuggaguaagucga

SEQ ID NO: 7152 - RNA, 21 nt, artificial
  Completely synthesized
cuggaagugucaaacagaaug

SEQ ID NO: 7153 - RNA, 21 nt, artificial
  Completely synthesized
ccuacugaaaaaacaacucag

SEQ ID NO: 7154 - RNA, 21 nt, artificial
  Completely synthesized
uaaaguggcugcucagaauug

SEQ ID NO: 7155 - RNA, 21 nt, artificial
  Completely synthesized
aaagaaguagguaacuguagu

SEQ ID NO: 7156 - RNA, 21 nt, artificial
  Completely synthesized
ccaaacugacagaaguugaca

SEQ ID NO: 7157 - RNA, 21 nt, artificial
  Completely synthesized
agcccaguaucagcaacagca

SEQ ID NO: 7158 - RNA, 21 nt, artificial
  Completely synthesized
uggagugucaguauguugaau

SEQ ID NO: 7159 - RNA, 21 nt, artificial
  Completely synthesized
guacuauuauacuaaaagcuc

SEQ ID NO: 7160 - RNA, 21 nt, artificial
  Completely synthesized
uugacuucagucagcgacgga

SEQ ID NO: 7161 - RNA, 21 nt, artificial
  Completely synthesized
ccuuuucugagcuaguuuuuu

SEQ ID NO: 7162 - RNA, 21 nt, artificial
  Completely synthesized
caagauauagaucuuggagua

SEQ ID NO: 7163 - RNA, 21 nt, artificial
  Completely synthesized
aacuggaaaauauaguagaac

SEQ ID NO: 7164 - RNA, 21 nt, artificial
  Completely synthesized
gaaaugauguccaaagagcag

SEQ ID NO: 7165 - RNA, 21 nt, artificial
  Completely synthesized
aauucagaugccacagucaac

SEQ ID NO: 7166 - RNA, 21 nt, artificial
  Completely synthesized
aaauugcucaaagaaaaagga

SEQ ID NO: 7167 - RNA, 21 nt, artificial
  Completely synthesized
ugaacuuagggcaaaagcucu

SEQ ID NO: 7168 - RNA, 21 nt, artificial
  Completely synthesized
uucagcaugcuacgugaugaa

SEQ ID NO: 7169 - RNA, 21 nt, artificial
  Completely synthesized
gaucuaucacuuugcaaagcu

SEQ ID NO: 7170 - RNA, 21 nt, artificial
  Completely synthesized
ccagagaaagaauugccugua

SEQ ID NO: 7171 - RNA, 21 nt, artificial
  Completely synthesized
gguaugcaacaggacauugag

SEQ ID NO: 7172 - RNA, 21 nt, artificial
  Completely synthesized
aaucaguaguuucacuuuaac

SEQ ID NO: 7173 - RNA, 21 nt, artificial
  Completely synthesized
cuuuaagccauucacucucug

SEQ ID NO: 7174 - RNA, 21 nt, artificial
  Completely synthesized
acuuggccucagugauucuga

SEQ ID NO: 7175 - RNA, 21 nt, artificial
  Completely synthesized
uuucacuaaacacaaguccca

SEQ ID NO: 7176 - RNA, 21 nt, artificial
  Completely synthesized
aaugauucugacuccggcauu

SEQ ID NO: 7177 - RNA, 21 nt, artificial
  Completely synthesized
uuaagccauucacucucugaa

SEQ ID NO: 7178 - RNA, 21 nt, artificial
  Completely synthesized
cuuuuucgcucaguuacaacu

SEQ ID NO: 7179 - RNA, 21 nt, artificial
  Completely synthesized
gaauugccuguaaguccuggu

SEQ ID NO: 7180 - RNA, 21 nt, artificial
  Completely synthesized
uuuaagccauucacucucuga

SEQ ID NO: 7181 - RNA, 21 nt, artificial
  Completely synthesized
auuauccauuccugaguuaca

SEQ ID NO: 7182 - RNA, 21 nt, artificial
  Completely synthesized
acuucagucagcgacggaaag

SEQ ID NO: 7183 - RNA, 21 nt, artificial
  Completely synthesized
uagaugaagagacaggugaau

SEQ ID NO: 7184 - RNA, 21 nt, artificial
  Completely synthesized
gaaaaaaucauuaaccucccu

SEQ ID NO: 7185 - RNA, 21 nt, artificial
  Completely synthesized
caacacagauuuuggugauga

SEQ ID NO: 7186 - RNA, 21 nt, artificial
  Completely synthesized
uaauauugaaaaugacaagcu

SEQ ID NO: 7187 - RNA, 21 nt, artificial
  Completely synthesized
uuuaagagcugguacuaauaa

SEQ ID NO: 7188 - RNA, 21 nt, artificial
  Completely synthesized
guccaaagagcaguucaauga

SEQ ID NO: 7189 - RNA, 21 nt, artificial
  Completely synthesized
acuuagggcaaaagcucucca

SEQ ID NO: 7190 - RNA, 21 nt, artificial
  Completely synthesized
augaaaaagaaaaauugcuca

SEQ ID NO: 7191 - RNA, 21 nt, artificial
  Completely synthesized
gaauugcagaaaaagaaaacu

SEQ ID NO: 7192 - RNA, 21 nt, artificial
  Completely synthesized
agaaguauuugacuucaguca

SEQ ID NO: 7193 - RNA, 21 nt, artificial
  Completely synthesized
cagucaccugaaacuucuguu

SEQ ID NO: 7194 - RNA, 21 nt, artificial
  Completely synthesized
acauuuucuuaaugcuuuuga

SEQ ID NO: 7195 - RNA, 21 nt, artificial
  Completely synthesized
aaguaauucuaugcaaaauca

SEQ ID NO: 7196 - RNA, 21 nt, artificial
  Completely synthesized
aaaaggaaagacaagaacaac

SEQ ID NO: 7197 - RNA, 21 nt, artificial
  Completely synthesized
uauucugcuuucauagcugag

SEQ ID NO: 7198 - RNA, 21 nt, artificial
  Completely synthesized
uuuauaaauacuguauggaca

SEQ ID NO: 7199 - RNA, 21 nt, artificial
  Completely synthesized
aaaacuagauuuaggaggauu

SEQ ID NO: 7200 - RNA, 21 nt, artificial
  Completely synthesized
ccagcuauggagacacacuac

SEQ ID NO: 7201 - RNA, 21 nt, artificial
  Completely synthesized
uccugauauucccggucacau

SEQ ID NO: 7202 - RNA, 21 nt, artificial
  Completely synthesized
uuauacuguucuuaugucauu

SEQ ID NO: 7203 - RNA, 21 nt, artificial
  Completely synthesized
aacacucaguggaaucuucca

SEQ ID NO: 7204 - RNA, 21 nt, artificial
  Completely synthesized
auaucccauucccuguagaaa

SEQ ID NO: 7205 - RNA, 21 nt, artificial
  Completely synthesized
guauguugaaucaguaguuuc

SEQ ID NO: 7206 - RNA, 21 nt, artificial
  Completely synthesized
gaaagccuuuuucgcucaguu

SEQ ID NO: 7207 - RNA, 21 nt, artificial
  Completely synthesized
ucacuaaacacaagucccagu

SEQ ID NO: 7208 - RNA, 21 nt, artificial
  Completely synthesized
acagcagaauucaaugauucu

SEQ ID NO: 7209 - RNA, 21 nt, artificial
  Completely synthesized
aaacagaaaaaacuugaaaag

SEQ ID NO: 7210 - RNA, 21 nt, artificial
  Completely synthesized
cuacuaaucaggcucagucac

SEQ ID NO: 7211 - RNA, 21 nt, artificial
  Completely synthesized
caacuagaugaagagacaggu

SEQ ID NO: 7212 - RNA, 21 nt, artificial
  Completely synthesized
ccaaagagcaguucaaugaag

SEQ ID NO: 7213 - RNA, 21 nt, artificial
  Completely synthesized
cuuggaggcucaucucacaag

SEQ ID NO: 7214 - RNA, 21 nt, artificial
  Completely synthesized
aaacauucaagccgcuuggag

SEQ ID NO: 7215 - RNA, 21 nt, artificial
  Completely synthesized
cauuugggcuaguuucugugu

SEQ ID NO: 7216 - RNA, 21 nt, artificial
  Completely synthesized
auugauguuucugaucuauca

SEQ ID NO: 7217 - RNA, 21 nt, artificial
  Completely synthesized
aguuuucagcaugcuacguga

SEQ ID NO: 7218 - RNA, 21 nt, artificial
  Completely synthesized
uccagcuauggagacacacua

SEQ ID NO: 7219 - RNA, 21 nt, artificial
  Completely synthesized
aaccaguugacagugaacuca

SEQ ID NO: 7220 - RNA, 21 nt, artificial
  Completely synthesized
ugacaagcugguugagacuac

SEQ ID NO: 7221 - RNA, 21 nt, artificial
  Completely synthesized
gaggauuugaccuuuucugag

SEQ ID NO: 7222 - RNA, 21 nt, artificial
  Completely synthesized
gcucaacuugcauuaauucgg

SEQ ID NO: 7223 - RNA, 21 nt, artificial
  Completely synthesized
gaugaacuuagggcaaaagcu

SEQ ID NO: 7224 - RNA, 21 nt, artificial
  Completely synthesized
ucuaucacuuugcaaagcuuu

SEQ ID NO: 7225 - RNA, 21 nt, artificial
  Completely synthesized
cauuuuuacucaucuauaccc

SEQ ID NO: 7226 - RNA, 21 nt, artificial
  Completely synthesized
ccuuauucuccuagugaauac

SEQ ID NO: 7227 - RNA, 21 nt, artificial
  Completely synthesized
aaaaaaucauuaaccucccug

SEQ ID NO: 7228 - RNA, 21 nt, artificial
  Completely synthesized
acacagauuuuggugaugaau

SEQ ID NO: 7229 - RNA, 21 nt, artificial
  Completely synthesized
acaacuagaugaagagacagg

SEQ ID NO: 7230 - RNA, 21 nt, artificial
  Completely synthesized
gaaauuauugcaaaacuaacc

SEQ ID NO: 7231 - RNA, 21 nt, artificial
  Completely synthesized
uccuuguucccaaaaguaaga

SEQ ID NO: 7232 - RNA, 21 nt, artificial
  Completely synthesized
agcucaacuugcauuaauucg

SEQ ID NO: 7233 - RNA, 21 nt, artificial
  Completely synthesized
auucccuguagaaaaaaucau

SEQ ID NO: 7234 - RNA, 21 nt, artificial
  Completely synthesized
caguaguuucacuuuaacugu

SEQ ID NO: 7235 - RNA, 21 nt, artificial
  Completely synthesized
cucaguuacaacuagaugaag

SEQ ID NO: 7236 - RNA, 21 nt, artificial
  Completely synthesized
aaugugagaacacaccagaga

SEQ ID NO: 7237 - RNA, 21 nt, artificial
  Completely synthesized
uaaccucccuguuguugacuu

SEQ ID NO: 7238 - RNA, 21 nt, artificial
  Completely synthesized
ucauagcugagcccaguauca

SEQ ID NO: 7239 - RNA, 21 nt, artificial
  Completely synthesized
agauggcaauguuuuccuugu

SEQ ID NO: 7240 - RNA, 21 nt, artificial
  Completely synthesized
acaagagauggcaauguuuuc

SEQ ID NO: 7241 - RNA, 21 nt, artificial
  Completely synthesized
gcaagagaaagccuuuuucgc

SEQ ID NO: 7242 - RNA, 21 nt, artificial
  Completely synthesized
uucaaugaagcucaacuugca

SEQ ID NO: 7243 - RNA, 21 nt, artificial
  Completely synthesized
caguggaucugccaacuacuc

SEQ ID NO: 7244 - RNA, 21 nt, artificial
  Completely synthesized
caggcucagucaccugaaacu

SEQ ID NO: 7245 - RNA, 21 nt, artificial
  Completely synthesized
cuguguaaguguaaauacuac

SEQ ID NO: 7246 - RNA, 21 nt, artificial
  Completely synthesized
auggauuugauugacauacuu

SEQ ID NO: 7247 - RNA, 21 nt, artificial
  Completely synthesized
gcaaacaagagauggcaaugu

SEQ ID NO: 7248 - RNA, 21 nt, artificial
  Completely synthesized
guucaaugaagcucaacuugc

SEQ ID NO: 7249 - RNA, 21 nt, artificial
  Completely synthesized
ccaugguuccaaguccagaag

SEQ ID NO: 7250 - RNA, 21 nt, artificial
  Completely synthesized
aauugcucaaagaaaaaggag

SEQ ID NO: 7251 - RNA, 21 nt, artificial
  Completely synthesized
agcagaauucaaugauucuga

SEQ ID NO: 7252 - RNA, 21 nt, artificial
  Completely synthesized
acaccauuugggcuaguuucu

SEQ ID NO: 7253 - RNA, 21 nt, artificial
  Completely synthesized
aaaagcauuggagugucagua

SEQ ID NO: 7254 - RNA, 21 nt, artificial
  Completely synthesized
uuuuucuuugagcaauuuuuc

SEQ ID NO: 7255 - RNA, 21 nt, artificial
  Completely synthesized
uuuccuuuucaaguuuuuucu

SEQ ID NO: 7256 - RNA, 21 nt, artificial
  Completely synthesized
uuaaugauuuuuucuacaggg

SEQ ID NO: 7257 - RNA, 21 nt, artificial
  Completely synthesized
uuaaagugaaacuacugauuc

SEQ ID NO: 7258 - RNA, 21 nt, artificial
  Completely synthesized
ucaaguuuuuucuguuuuucc

SEQ ID NO: 7259 - RNA, 21 nt, artificial
  Completely synthesized
uuuucuuuuucugcaauucug

SEQ ID NO: 7260 - RNA, 21 nt, artificial
  Completely synthesized
uuccuuuucaaguuuuuucug

SEQ ID NO: 7261 - RNA, 21 nt, artificial
  Completely synthesized
uuugucauuuucuccuuuuuc

SEQ ID NO: 7262 - RNA, 21 nt, artificial
  Completely synthesized
uucaaguuuuuucuguuuuuc

SEQ ID NO: 7263 - RNA, 21 nt, artificial
  Completely synthesized
uucaaaugaucuaaaucuugc

SEQ ID NO: 7264 - RNA, 21 nt, artificial
  Completely synthesized
ucuaguucuacuauauuuucc

SEQ ID NO: 7265 - RNA, 21 nt, artificial
  Completely synthesized
ucauuuucuccuuuuucuuug

SEQ ID NO: 7266 - RNA, 21 nt, artificial
  Completely synthesized
uuuucuauacuaguuuuggcu

SEQ ID NO: 7267 - RNA, 21 nt, artificial
  Completely synthesized
uuuuccaguuuucuuuuucug

SEQ ID NO: 7268 - RNA, 21 nt, artificial
  Completely synthesized
uugucauuuucuccuuuuucu

SEQ ID NO: 7269 - RNA, 21 nt, artificial
  Completely synthesized
uuucaaaugaucuaaaucuug

SEQ ID NO: 7270 - RNA, 21 nt, artificial
  Completely synthesized
uauuuucuauacuaguuuugg

SEQ ID NO: 7271 - RNA, 21 nt, artificial
  Completely synthesized
uuuucuuugagcaauuuuucu

SEQ ID NO: 7272 - RNA, 21 nt, artificial
  Completely synthesized
uuuuuuguccauacaguauuu

SEQ ID NO: 7273 - RNA, 21 nt, artificial
  Completely synthesized
uuucuuuuucugcaauucuga

SEQ ID NO: 7274 - RNA, 21 nt, artificial
  Completely synthesized
uaaaauucaucaccaaaaucu

SEQ ID NO: 7275 - RNA, 21 nt, artificial
  Completely synthesized
uuucuuugagcaauuuuucuu

SEQ ID NO: 7276 - RNA, 21 nt, artificial
  Completely synthesized
uucuuugagcaauuuuucuuu

SEQ ID NO: 7277 - RNA, 21 nt, artificial
  Completely synthesized
uuuuguaguauuuacacuuac

SEQ ID NO: 7278 - RNA, 21 nt, artificial
  Completely synthesized
uuauaaaaaaguacauagugg

SEQ ID NO: 7279 - RNA, 21 nt, artificial
  Completely synthesized
aaaaaaugccauuuuuugucc

SEQ ID NO: 7280 - RNA, 21 nt, artificial
  Completely synthesized
uaugaaagcagaauaaaauuc

SEQ ID NO: 7281 - RNA, 21 nt, artificial
  Completely synthesized
uugaauguuugucuuuuguga

SEQ ID NO: 7282 - RNA, 21 nt, artificial
  Completely synthesized
uuguccauacaguauuuauaa

SEQ ID NO: 7283 - RNA, 21 nt, artificial
  Completely synthesized
auauuaagacacuguaacuca

SEQ ID NO: 7284 - RNA, 21 nt, artificial
  Completely synthesized
uaguucuacuauauuuuccag

SEQ ID NO: 7285 - RNA, 21 nt, artificial
  Completely synthesized
uugcaauaauuucuuuuuagc

SEQ ID NO: 7286 - RNA, 21 nt, artificial
  Completely synthesized
uauuuuccaguuuucuuuuuc

SEQ ID NO: 7287 - RNA, 21 nt, artificial
  Completely synthesized
ugucauuuucaauauuaagac

SEQ ID NO: 7288 - RNA, 21 nt, artificial
  Completely synthesized
uauaaaguaugagcauuucac

SEQ ID NO: 7289 - RNA, 21 nt, artificial
  Completely synthesized
uuuuucaucuuucaaaugauc

SEQ ID NO: 7290 - RNA, 21 nt, artificial
  Completely synthesized
auuuucuauacuaguuuuggc

SEQ ID NO: 7291 - RNA, 21 nt, artificial
  Completely synthesized
uuucaauauuaagacacugua

SEQ ID NO: 7292 - RNA, 21 nt, artificial
  Completely synthesized
uugucuuuccuuuucaaguuu

SEQ ID NO: 7293 - RNA, 21 nt, artificial
  Completely synthesized
uuaccuacuucuuuuuccauu

SEQ ID NO: 7294 - RNA, 21 nt, artificial
  Completely synthesized
uucuuuuucaucuuucaaaug

SEQ ID NO: 7295 - RNA, 21 nt, artificial
  Completely synthesized
ucuuugagcaauuuuucuuuu

SEQ ID NO: 7296 - RNA, 21 nt, artificial
  Completely synthesized
uuuucaucuuucaaaugaucu

SEQ ID NO: 7297 - RNA, 21 nt, artificial
  Completely synthesized
aauguuugucuuuugugaaug

SEQ ID NO: 7298 - RNA, 21 nt, artificial
  Completely synthesized
ucuuucaaaugaucuaaaucu

SEQ ID NO: 7299 - RNA, 21 nt, artificial
  Completely synthesized
uuacaguuaaagugaaacuac

SEQ ID NO: 7300 - RNA, 21 nt, artificial
  Completely synthesized
uacuaguuuuggcuaugauuu

SEQ ID NO: 7301 - RNA, 21 nt, artificial
  Completely synthesized
uuuucaauauuaagacacugu

SEQ ID NO: 7302 - RNA, 21 nt, artificial
  Completely synthesized
ucuacuauauuuuccaguuuu

SEQ ID NO: 7303 - RNA, 21 nt, artificial
  Completely synthesized
ucauuuucaauauuaagacac

SEQ ID NO: 7304 - RNA, 21 nt, artificial
  Completely synthesized
uuucuauacuaguuuuggcua

SEQ ID NO: 7305 - RNA, 21 nt, artificial
  Completely synthesized
uaaaguaugagcauuucacau

SEQ ID NO: 7306 - RNA, 21 nt, artificial
  Completely synthesized
uucaauauuaagacacuguaa

SEQ ID NO: 7307 - RNA, 21 nt, artificial
  Completely synthesized
uugagcaauuuuucuuuuuca

SEQ ID NO: 7308 - RNA, 21 nt, artificial
  Completely synthesized
uccuuuucaaguuuuuucugu

SEQ ID NO: 7309 - RNA, 21 nt, artificial
  Completely synthesized
aaguuuuuucuguuuuuccag

SEQ ID NO: 7310 - RNA, 21 nt, artificial
  Completely synthesized
ugcaauaauuucuuuuuagcc

SEQ ID NO: 7311 - RNA, 21 nt, artificial
  Completely synthesized
ucuaguuuuucuuaacaucug

SEQ ID NO: 7312 - RNA, 21 nt, artificial
  Completely synthesized
auuuuuuguccauacaguauu

SEQ ID NO: 7313 - RNA, 21 nt, artificial
  Completely synthesized
uuuuguccauacaguauuuau

SEQ ID NO: 7314 - RNA, 21 nt, artificial
  Completely synthesized
uuauaaaguaugagcauuuca

SEQ ID NO: 7315 - RNA, 21 nt, artificial
  Completely synthesized
uuuauuaguaccagcucuuaa

SEQ ID NO: 7316 - RNA, 21 nt, artificial
  Completely synthesized
uuugagcaauuuuucuuuuuc

SEQ ID NO: 7317 - RNA, 21 nt, artificial
  Completely synthesized
auaaaauucaucaccaaaauc

SEQ ID NO: 7318 - RNA, 21 nt, artificial
  Completely synthesized
ugucauuuucuccuuuuucuu

SEQ ID NO: 7319 - RNA, 21 nt, artificial
  Completely synthesized
ucugaauuuaaugaguucacu

SEQ ID NO: 7320 - RNA, 21 nt, artificial
  Completely synthesized
auuuucaauauuaagacacug

SEQ ID NO: 7321 - RNA, 21 nt, artificial
  Completely synthesized
aauauuaagacacuguaacuc

SEQ ID NO: 7322 - RNA, 21 nt, artificial
  Completely synthesized
ucaauauuaagacacuguaac

SEQ ID NO: 7323 - RNA, 21 nt, artificial
  Completely synthesized
uccaaugcuuuuuaaaguuuc

SEQ ID NO: 7324 - RNA, 21 nt, artificial
  Completely synthesized
ucuuuuucaucuuucaaauga

SEQ ID NO: 7325 - RNA, 21 nt, artificial
  Completely synthesized
uacaguuaaagugaaacuacu

SEQ ID NO: 7326 - RNA, 21 nt, artificial
  Completely synthesized
uaauaguacaaaaaaacuagc

SEQ ID NO: 7327 - RNA, 21 nt, artificial
  Completely synthesized
auuacuuauaaaguaugagca

SEQ ID NO: 7328 - RNA, 21 nt, artificial
  Completely synthesized
aaaagcauuaagaaaaugugg

SEQ ID NO: 7329 - RNA, 21 nt, artificial
  Completely synthesized
uaaaaaaugccauuuuuuguc

SEQ ID NO: 7330 - RNA, 21 nt, artificial
  Completely synthesized
cuuuccuuuucaaguuuuuuc

SEQ ID NO: 7331 - RNA, 21 nt, artificial
  Completely synthesized
augcuuuuuaaaguuucguau

SEQ ID NO: 7332 - RNA, 21 nt, artificial
  Completely synthesized
ucguauuauuuucuauacuag

SEQ ID NO: 7333 - RNA, 21 nt, artificial
  Completely synthesized
ugucauaucaucauauaaauc

SEQ ID NO: 7334 - RNA, 21 nt, artificial
  Completely synthesized
uccaaaguaugucaaucaaau

SEQ ID NO: 7335 - RNA, 21 nt, artificial
  Completely synthesized
auuuacacuuacacagaaacu

SEQ ID NO: 7336 - RNA, 21 nt, artificial
  Completely synthesized
uacuauauuuuccaguuuucu

SEQ ID NO: 7337 - RNA, 21 nt, artificial
  Completely synthesized
ugucuuuccuuuucaaguuuu

SEQ ID NO: 7338 - RNA, 21 nt, artificial
  Completely synthesized
uaguauuuacacuuacacaga

SEQ ID NO: 7339 - RNA, 21 nt, artificial
  Completely synthesized
auaaaguaugagcauuucaca

SEQ ID NO: 7340 - RNA, 21 nt, artificial
  Completely synthesized
agcaauuuuucuuuuucaucu

SEQ ID NO: 7341 - RNA, 21 nt, artificial
  Completely synthesized
aaaugaucuaaaucuugcucu

SEQ ID NO: 7342 - RNA, 21 nt, artificial
  Completely synthesized
augauuuugcauagaauuacu

SEQ ID NO: 7343 - RNA, 21 nt, artificial
  Completely synthesized
uuuuggcuaugauuuugcaua

SEQ ID NO: 7344 - RNA, 21 nt, artificial
  Completely synthesized
uuuuuguccauacaguauuua

SEQ ID NO: 7345 - RNA, 21 nt, artificial
  Completely synthesized
guuaguuuugcaauaauuucu

SEQ ID NO: 7346 - RNA, 21 nt, artificial
  Completely synthesized
aucuaguuuuucuuaacaucu

SEQ ID NO: 7347 - RNA, 21 nt, artificial
  Completely synthesized
aaaguaugucaaucaaaucca

SEQ ID NO: 7348 - RNA, 21 nt, artificial
  Completely synthesized
uccuaaaucuaguuuuucuua

SEQ ID NO: 7349 - RNA, 21 nt, artificial
  Completely synthesized
auaacaaaugacauaagaaca

SEQ ID NO: 7350 - RNA, 21 nt, artificial
  Completely synthesized
cuauauuuuccaguuuucuuu

SEQ ID NO: 7351 - RNA, 21 nt, artificial
  Completely synthesized
uuuguccauacaguauuuaua

SEQ ID NO: 7352 - RNA, 21 nt, artificial
  Completely synthesized
uucuacuauauuuuccaguuu

SEQ ID NO: 7353 - RNA, 21 nt, artificial
  Completely synthesized
uuuuucuacagggaaugggau

SEQ ID NO: 7354 - RNA, 21 nt, artificial
  Completely synthesized
aauuacuuauaaaguaugagc

SEQ ID NO: 7355 - RNA, 21 nt, artificial
  Completely synthesized
uaauaauccuuuauuaguacc

SEQ ID NO: 7356 - RNA, 21 nt, artificial
  Completely synthesized
ucaucuuucaaaugaucuaaa

SEQ ID NO: 7357 - RNA, 21 nt, artificial
  Completely synthesized
uauuaguaccagcucuuaaaa

SEQ ID NO: 7358 - RNA, 21 nt, artificial
  Completely synthesized
uguaguauuuacacuuacaca

SEQ ID NO: 7359 - RNA, 21 nt, artificial
  Completely synthesized
uaggagcuuuuaguauaauag

SEQ ID NO: 7360 - RNA, 21 nt, artificial
  Completely synthesized
uauaacaaaugacauaagaac

SEQ ID NO: 7361 - RNA, 21 nt, artificial
  Completely synthesized
auuuucuccuuuuucuuugag

SEQ ID NO: 7362 - RNA, 21 nt, artificial
  Completely synthesized
aaaauucaucaccaaaaucug

SEQ ID NO: 7363 - RNA, 21 nt, artificial
  Completely synthesized
aaagcagaauaaaauucauca

SEQ ID NO: 7364 - RNA, 21 nt, artificial
  Completely synthesized
aauuuaaugaguucacuguca

SEQ ID NO: 7365 - RNA, 21 nt, artificial
  Completely synthesized
cucuaguucuacuauauuuuc

SEQ ID NO: 7366 - RNA, 21 nt, artificial
  Completely synthesized
uuguaguauuuacacuuacac

SEQ ID NO: 7367 - RNA, 21 nt, artificial
  Completely synthesized
uuuugucauuuucuccuuuuu

SEQ ID NO: 7368 - RNA, 21 nt, artificial
  Completely synthesized
uucaucuuucaaaugaucuaa

SEQ ID NO: 7369 - RNA, 21 nt, artificial
  Completely synthesized
aagguuuuccaucuucaucac

SEQ ID NO: 7370 - RNA, 21 nt, artificial
  Completely synthesized
ugcuuuuuaaaguuucguauu

SEQ ID NO: 7371 - RNA, 21 nt, artificial
  Completely synthesized
uuuacacuuacacagaaacua

SEQ ID NO: 7372 - RNA, 21 nt, artificial
  Completely synthesized
auuaagaaaauguggacuaca

SEQ ID NO: 7373 - RNA, 21 nt, artificial
  Completely synthesized
uuuguaguauuuacacuuaca

SEQ ID NO: 7374 - RNA, 21 nt, artificial
  Completely synthesized
aaugcuuuuuaaaguuucgua

SEQ ID NO: 7375 - RNA, 21 nt, artificial
  Completely synthesized
auuuuccaguuuucuuuuucu

SEQ ID NO: 7376 - RNA, 21 nt, artificial
  Completely synthesized
uaaaaaaguacauagugguua

SEQ ID NO: 7377 - RNA, 21 nt, artificial
  Completely synthesized
uauuuacacuuacacagaaac

SEQ ID NO: 7378 - RNA, 21 nt, artificial
  Completely synthesized
ugaguaaaaaugauaauuguc

SEQ ID NO: 7379 - RNA, 21 nt, artificial
  Completely synthesized
guuaaugauuuuuucuacagg

SEQ ID NO: 7380 - RNA, 21 nt, artificial
  Completely synthesized
uaaugauuuuuucuacaggga

SEQ ID NO: 7381 - RNA, 21 nt, artificial
  Completely synthesized
ugcucuaguucuacuauauuu

SEQ ID NO: 7382 - RNA, 21 nt, artificial
  Completely synthesized
acuauauuuuccaguuuucuu

SEQ ID NO: 7383 - RNA, 21 nt, artificial
  Completely synthesized
aaaaguacauagugguuaguu

SEQ ID NO: 7384 - RNA, 21 nt, artificial
  Completely synthesized
uaugauuuugcauagaauuac

SEQ ID NO: 7385 - RNA, 21 nt, artificial
  Completely synthesized
uuugggaacaaggaaaacauu

SEQ ID NO: 7386 - RNA, 21 nt, artificial
  Completely synthesized
aauuucuuuuuagccagaugu

SEQ ID NO: 7387 - RNA, 21 nt, artificial
  Completely synthesized
cuaguuuuggcuaugauuuug

SEQ ID NO: 7388 - RNA, 21 nt, artificial
  Completely synthesized
uauaaaaaaguacauaguggu

SEQ ID NO: 7389 - RNA, 21 nt, artificial
  Completely synthesized
aaaaaaguacauagugguuag

SEQ ID NO: 7390 - RNA, 21 nt, artificial
  Completely synthesized
uggcugaauugggagaaauuc

SEQ ID NO: 7391 - RNA, 21 nt, artificial
  Completely synthesized
agaaucacugaggccaaguag

SEQ ID NO: 7392 - RNA, 21 nt, artificial
  Completely synthesized
uugcucuaguucuacuauauu

SEQ ID NO: 7393 - RNA, 21 nt, artificial
  Completely synthesized
auacucuuuccgucgcugacu

SEQ ID NO: 7394 - RNA, 21 nt, artificial
  Completely synthesized
ugguuaguuuugcaauaauuu

SEQ ID NO: 7395 - RNA, 21 nt, artificial
  Completely synthesized
ucuauacuaguuuuggcuaug

SEQ ID NO: 7396 - RNA, 21 nt, artificial
  Completely synthesized
aguucuacuauauuuuccagu

SEQ ID NO: 7397 - RNA, 21 nt, artificial
  Completely synthesized
ugaauguuugucuuuugugaa

SEQ ID NO: 7398 - RNA, 21 nt, artificial
  Completely synthesized
caucacaguaggagcuuuuag

SEQ ID NO: 7399 - RNA, 21 nt, artificial
  Completely synthesized
caaguuuuuucuguuuuucca

SEQ ID NO: 7400 - RNA, 21 nt, artificial
  Completely synthesized
uuacuuauaaaguaugagcau

SEQ ID NO: 7401 - RNA, 21 nt, artificial
  Completely synthesized
uguccuaagaaauuguuuaca

SEQ ID NO: 7402 - RNA, 21 nt, artificial
  Completely synthesized
augaaagcagaauaaaauuca

SEQ ID NO: 7403 - RNA, 21 nt, artificial
  Completely synthesized
uaacaaaugacauaagaacag

SEQ ID NO: 7404 - RNA, 21 nt, artificial
  Completely synthesized
uuuacaguuaaagugaaacua

SEQ ID NO: 7405 - RNA, 21 nt, artificial
  Completely synthesized
auuuaaugaguucacugucaa

SEQ ID NO: 7406 - RNA, 21 nt, artificial
  Completely synthesized
ugagcuucauugaacugcucu

SEQ ID NO: 7407 - RNA, 21 nt, artificial
  Completely synthesized
aaugauaauugucaacuucug

SEQ ID NO: 7408 - RNA, 21 nt, artificial
  Completely synthesized
uggcaucugaauuuaaugagu

SEQ ID NO: 7409 - RNA, 21 nt, artificial
  Completely synthesized
aaaaugauaauugucaacuuc

SEQ ID NO: 7410 - RNA, 21 nt, artificial
  Completely synthesized
caucuggcuucuuacuuuugg

SEQ ID NO: 7411 - RNA, 21 nt, artificial
  Completely synthesized
augcaaguugagcuucauuga

SEQ ID NO: 7412 - RNA, 21 nt, artificial
  Completely synthesized
aauuguuuacaguuaaaguga

SEQ ID NO: 7413 - RNA, 21 nt, artificial
  Completely synthesized
auaauccuuuauuaguaccag

SEQ ID NO: 7414 - RNA, 21 nt, artificial
  Completely synthesized
uucagaaucacugaggccaag

SEQ ID NO: 7415 - RNA, 21 nt, artificial
  Completely synthesized
aaauucaucaccaaaaucugu

SEQ ID NO: 7416 - RNA, 21 nt, artificial
  Completely synthesized
aaguuuuuguaguauuuacac

SEQ ID NO: 7417 - RNA, 21 nt, artificial
  Completely synthesized
uaaagugaaacuacugauuca

SEQ ID NO: 7418 - RNA, 21 nt, artificial
  Completely synthesized
gaagaaaccucauugucaucu

SEQ ID NO: 7419 - RNA, 21 nt, artificial
  Completely synthesized
agggcaugcuguugcugauac

SEQ ID NO: 7420 - RNA, 21 nt, artificial
  Completely synthesized
ugcauagaauuacuuauaaag

SEQ ID NO: 7421 - RNA, 21 nt, artificial
  Completely synthesized
aucuugccuccaaaguauguc

SEQ ID NO: 7422 - RNA, 21 nt, artificial
  Completely synthesized
gucauuuucuccuuuuucuuu

SEQ ID NO: 7423 - RNA, 21 nt, artificial
  Completely synthesized
uaauuucuuuuuagccagaug

SEQ ID NO: 7424 - RNA, 21 nt, artificial
  Completely synthesized
aucugaauuuaaugaguucac

SEQ ID NO: 7425 - RNA, 21 nt, artificial
  Completely synthesized
agugaaacuacugauucaaca

SEQ ID NO: 7426 - RNA, 21 nt, artificial
  Completely synthesized
uaggugaaggcuuuugucauu

SEQ ID NO: 7427 - RNA, 21 nt, artificial
  Completely synthesized
ggacuuacaggcaauucuuuc

SEQ ID NO: 7428 - RNA, 21 nt, artificial
  Completely synthesized
aggagaauaagguuuuccauc

SEQ ID NO: 7429 - RNA, 21 nt, artificial
  Completely synthesized
aggagcuuuuaguauaauagu

SEQ ID NO: 7430 - RNA, 21 nt, artificial
  Completely synthesized
uacaguuaccuacuucuuuuu

SEQ ID NO: 7431 - RNA, 21 nt, artificial
  Completely synthesized
uucuauacuaguuuuggcuau

SEQ ID NO: 7432 - RNA, 21 nt, artificial
  Completely synthesized
ucuuuccgucgcugacugaag

SEQ ID NO: 7433 - RNA, 21 nt, artificial
  Completely synthesized
uaaugcaaguugagcuucauu

SEQ ID NO: 7434 - RNA, 21 nt, artificial
  Completely synthesized
uauacuaguuuuggcuaugau

SEQ ID NO: 7435 - RNA, 21 nt, artificial
  Completely synthesized
cuuucaaaugaucuaaaucuu

SEQ ID NO: 7436 - RNA, 21 nt, artificial
  Completely synthesized
cugagauggugacaaggguug

SEQ ID NO: 7437 - RNA, 21 nt, artificial
  Completely synthesized
acagggaaugggauauggaga

SEQ ID NO: 7438 - RNA, 21 nt, artificial
  Completely synthesized
ucaggugacugagccugauua

SEQ ID NO: 7439 - RNA, 21 nt, artificial
  Completely synthesized
uccaagcggcuugaauguuug

SEQ ID NO: 7440 - RNA, 21 nt, artificial
  Completely synthesized
aaaugauaauugucaacuucu

SEQ ID NO: 7441 - RNA, 21 nt, artificial
  Completely synthesized
cuaucuagcucuuccacuuca

SEQ ID NO: 7442 - RNA, 21 nt, artificial
  Completely synthesized
acuacugauucaacauacuga

SEQ ID NO: 7443 - RNA, 21 nt, artificial
  Completely synthesized
gagguuaaugauuuuuucuac

SEQ ID NO: 7444 - RNA, 21 nt, artificial
  Completely synthesized
uacugguguuuuaggaccauu

SEQ ID NO: 7445 - RNA, 21 nt, artificial
  Completely synthesized
uacaaaaaaacuagcucagaa

SEQ ID NO: 7446 - RNA, 21 nt, artificial
  Completely synthesized
aauaauuucuuuuuagccaga

SEQ ID NO: 7447 - RNA, 21 nt, artificial
  Completely synthesized
ugacauaagaacaguauaaau

SEQ ID NO: 7448 - RNA, 21 nt, artificial
  Completely synthesized
uguaacugagcgaaaaaggcu

SEQ ID NO: 7449 - RNA, 21 nt, artificial
  Completely synthesized
guuuuuguaguauuuacacuu

SEQ ID NO: 7450 - RNA, 21 nt, artificial
  Completely synthesized
auacuaguuuuggcuaugauu

SEQ ID NO: 7451 - RNA, 21 nt, artificial
  Completely synthesized
aauaguacaaaaaaacuagcu

SEQ ID NO: 7452 - RNA, 21 nt, artificial
  Completely synthesized
gauuuuuucuacagggaaugg

SEQ ID NO: 7453 - RNA, 21 nt, artificial
  Completely synthesized
gaugaguaaaaaugauaauug

SEQ ID NO: 7454 - RNA, 21 nt, artificial
  Completely synthesized
uccucaaaagcauuaagaaaa

SEQ ID NO: 7455 - RNA, 21 nt, artificial
  Completely synthesized
auagugguuaguuuugcaaua

SEQ ID NO: 7456 - RNA, 21 nt, artificial
  Completely synthesized
aucuucaucacguagcaugcu

SEQ ID NO: 7457 - RNA, 21 nt, artificial
  Completely synthesized
aucuuucaaaugaucuaaauc

SEQ ID NO: 7458 - RNA, 21 nt, artificial
  Completely synthesized
uaguacaaaaaaacuagcuca

SEQ ID NO: 7459 - RNA, 21 nt, artificial
  Completely synthesized
uugucaucuacaaacgggaau

SEQ ID NO: 7460 - RNA, 21 nt, artificial
  Completely synthesized
ucaaaugaucuaaaucuugcu

SEQ ID NO: 7461 - RNA, 21 nt, artificial
  Completely synthesized
ccaucuucaucacguagcaug

SEQ ID NO: 7462 - RNA, 21 nt, artificial
  Completely synthesized
uuuuuccauugaggguauaga

SEQ ID NO: 7463 - RNA, 21 nt, artificial
  Completely synthesized
ugccacacugggacuuguguu

SEQ ID NO: 7464 - RNA, 21 nt, artificial
  Completely synthesized
aaguacauagugguuaguuuu

SEQ ID NO: 7465 - RNA, 21 nt, artificial
  Completely synthesized
agguuaaugauuuuuucuaca

SEQ ID NO: 7466 - RNA, 21 nt, artificial
  Completely synthesized
cuuuugucauuuucuccuuuu

SEQ ID NO: 7467 - RNA, 21 nt, artificial
  Completely synthesized
uugaaagcuuugcaaagugau

SEQ ID NO: 7468 - RNA, 21 nt, artificial
  Completely synthesized
aaauccuccuaaaucuaguuu

SEQ ID NO: 7469 - RNA, 21 nt, artificial
  Completely synthesized
aaugggauauggagagcuuuu

SEQ ID NO: 7470 - RNA, 21 nt, artificial
  Completely synthesized
aagcagaauaaaauucaucac

SEQ ID NO: 7471 - RNA, 21 nt, artificial
  Completely synthesized
aaagugauagaucagaaacau

SEQ ID NO: 7472 - RNA, 21 nt, artificial
  Completely synthesized
uacaaagcaucugauuuggga

SEQ ID NO: 7473 - RNA, 21 nt, artificial
  Completely synthesized
agaauguacugguguuuuagg

SEQ ID NO: 7474 - RNA, 21 nt, artificial
  Completely synthesized
acuaguuuuggcuaugauuuu

SEQ ID NO: 7475 - RNA, 21 nt, artificial
  Completely synthesized
acucaggaauggauaauagcu

SEQ ID NO: 7476 - RNA, 21 nt, artificial
  Completely synthesized
ucuuuccuuuucaaguuuuuu

SEQ ID NO: 7477 - RNA, 21 nt, artificial
  Completely synthesized
ugguuuugguugaaagcuuug

SEQ ID NO: 7478 - RNA, 21 nt, artificial
  Completely synthesized
aguuaaagugaaacuacugau

SEQ ID NO: 7479 - RNA, 21 nt, artificial
  Completely synthesized
uaguuggcagauccacugguu

SEQ ID NO: 7480 - RNA, 21 nt, artificial
  Completely synthesized
gucaaauccuccuaaaucuag

SEQ ID NO: 7481 - RNA, 21 nt, artificial
  Completely synthesized
aagaauguacugguguuuuag

SEQ ID NO: 7482 - RNA, 21 nt, artificial
  Completely synthesized
uacuuauaaaguaugagcauu

SEQ ID NO: 7483 - RNA, 21 nt, artificial
  Completely synthesized
guuggcagauccacugguuuc

SEQ ID NO: 7484 - RNA, 21 nt, artificial
  Completely synthesized
cucugguguguucucacauug

SEQ ID NO: 7485 - RNA, 21 nt, artificial
  Completely synthesized
ugaauuuaaugaguucacugu

SEQ ID NO: 7486 - RNA, 21 nt, artificial
  Completely synthesized
aagcggcuugaauguuugucu

SEQ ID NO: 7487 - RNA, 21 nt, artificial
  Completely synthesized
ucagcuaugaaagcagaauaa

SEQ ID NO: 7488 - RNA, 21 nt, artificial
  Completely synthesized
aguagcaaugaagacugggcu

SEQ ID NO: 7489 - RNA, 21 nt, artificial
  Completely synthesized
aaguacaaagcaucugauuug

SEQ ID NO: 7490 - RNA, 21 nt, artificial
  Completely synthesized
guugagcuucauugaacugcu

SEQ ID NO: 7491 - RNA, 21 nt, artificial
  Completely synthesized
acaguaggagcuuuuaguaua

SEQ ID NO: 7492 - RNA, 21 nt, artificial
  Completely synthesized
acugacacuccaaugcuuuuu

SEQ ID NO: 7493 - RNA, 21 nt, artificial
  Completely synthesized
aaacauugccaucucuuguuu

SEQ ID NO: 7494 - RNA, 21 nt, artificial
  Completely synthesized
ucucuucaucuaguuguaacu

SEQ ID NO: 7495 - RNA, 21 nt, artificial
  Completely synthesized
guuuucuuuuucugcaauucu

SEQ ID NO: 7496 - RNA, 21 nt, artificial
  Completely synthesized
uagugguuaguuuugcaauaa

SEQ ID NO: 7497 - RNA, 21 nt, artificial
  Completely synthesized
cuaugaauauaacaaaugaca

SEQ ID NO: 7498 - RNA, 21 nt, artificial
  Completely synthesized
uuccgucgcugacugaaguca

SEQ ID NO: 7499 - RNA, 21 nt, artificial
  Completely synthesized
aaaaaugccauuuuuugucca

SEQ ID NO: 7500 - RNA, 21 nt, artificial
  Completely synthesized
cuacuauauuuuccaguuuuc

SEQ ID NO: 7501 - RNA, 21 nt, artificial
  Completely synthesized
uugccuccaaaguaugucaau

SEQ ID NO: 7502 - RNA, 21 nt, artificial
  Completely synthesized
uuacuccaagaucuauaucuu

SEQ ID NO: 7503 - RNA, 21 nt, artificial
  Completely synthesized
caauaauuucuuuuuagccag

SEQ ID NO: 7504 - RNA, 21 nt, artificial
  Completely synthesized
aaauuguuuacaguuaaagug

SEQ ID NO: 7505 - RNA, 21 nt, artificial
  Completely synthesized
uuucaguaggugaaggcuuuu

SEQ ID NO: 7506 - RNA, 21 nt, artificial
  Completely synthesized
aguacaaagcaucugauuugg

SEQ ID NO: 7507 - RNA, 21 nt, artificial
  Completely synthesized
uacacagaaacuagcccaaau

SEQ ID NO: 7508 - RNA, 21 nt, artificial
  Completely synthesized
caucugauuugggaauguggg

SEQ ID NO: 7509 - RNA, 21 nt, artificial
  Completely synthesized
guuuuuccagcucauacucuu

SEQ ID NO: 7510 - RNA, 21 nt, artificial
  Completely synthesized
aaucacugaggccaaguagug

SEQ ID NO: 7511 - RNA, 21 nt, artificial
  Completely synthesized
uagccagaugucauaucauca

SEQ ID NO: 7512 - RNA, 21 nt, artificial
  Completely synthesized
ucuccauagcuggaagauucc

SEQ ID NO: 7513 - RNA, 21 nt, artificial
  Completely synthesized
ugaugccacacugggacuugu

SEQ ID NO: 7514 - RNA, 21 nt, artificial
  Completely synthesized
aguugagcuucauugaacugc

SEQ ID NO: 7515 - RNA, 21 nt, artificial
  Completely synthesized
ucuaugaauauaacaaaugac

SEQ ID NO: 7516 - RNA, 21 nt, artificial
  Completely synthesized
aaagcauuaagaaaaugugga

SEQ ID NO: 7517 - RNA, 21 nt, artificial
  Completely synthesized
aacaaaugacauaagaacagu

SEQ ID NO: 7518 - RNA, 21 nt, artificial
  Completely synthesized
uucauugaacugcucuuugga

SEQ ID NO: 7519 - RNA, 21 nt, artificial
  Completely synthesized
ucuucaucuaguuguaacuga

SEQ ID NO: 7520 - RNA, 21 nt, artificial
  Completely synthesized
cuaugaaagcagaauaaaauu

SEQ ID NO: 7521 - RNA, 21 nt, artificial
  Completely synthesized
gaaaauguggacuacaguuac

SEQ ID NO: 7522 - RNA, 21 nt, artificial
  Completely synthesized
cuaguucuacuauauuuucca

SEQ ID NO: 7523 - RNA, 21 nt, artificial
  Completely synthesized
cuugucauuuucaauauuaag

SEQ ID NO: 7524 - RNA, 21 nt, artificial
  Completely synthesized
acuguaacucaggaauggaua

SEQ ID NO: 7525 - RNA, 21 nt, artificial
  Completely synthesized
cugacacuccaaugcuuuuua

SEQ ID NO: 7526 - RNA, 21 nt, artificial
  Completely synthesized
gucucuucaucuaguuguaac

SEQ ID NO: 7527 - RNA, 21 nt, artificial
  Completely synthesized
aguaggugaaggcuuuuguca

SEQ ID NO: 7528 - RNA, 21 nt, artificial
  Completely synthesized
aaucuaguuuuucuuaacauc

SEQ ID NO: 7529 - RNA, 21 nt, artificial
  Completely synthesized
gaguucacugucaacugguug

SEQ ID NO: 7530 - RNA, 21 nt, artificial
  Completely synthesized
auaauuucuuuuuagccagau

SEQ ID NO: 7531 - RNA, 21 nt, artificial
  Completely synthesized
aucacguagcaugcugaaaac

SEQ ID NO: 7532 - RNA, 21 nt, artificial
  Completely synthesized
ccugauuaguagcaaugaaga

SEQ ID NO: 7533 - RNA, 21 nt, artificial
  Completely synthesized
ugcaugcagucaucaaaguac

SEQ ID NO: 7534 - RNA, 21 nt, artificial
  Completely synthesized
auaaaaaaguacauagugguu

SEQ ID NO: 7535 - RNA, 21 nt, artificial
  Completely synthesized
augauaauugucaacuucugu

SEQ ID NO: 7536 - RNA, 21 nt, artificial
  Completely synthesized
uuucaucuuucaaaugaucua

SEQ ID NO: 7537 - RNA, 21 nt, artificial
  Completely synthesized
aguuuuuguaguauuuacacu

SEQ ID NO: 7538 - RNA, 21 nt, artificial
  Completely synthesized
aaaacauugccaucucuuguu

SEQ ID NO: 7539 - RNA, 21 nt, artificial
  Completely synthesized
gucauaucaucauauaaaucu

SEQ ID NO: 7540 - RNA, 21 nt, artificial
  Completely synthesized
gacaaggguuguaccauaucc

SEQ ID NO: 7541 - RNA, 21 nt, artificial
  Completely synthesized
aacauacugacacuccaaugc

SEQ ID NO: 7542 - RNA, 21 nt, artificial
  Completely synthesized
caauauuaagacacuguaacu

SEQ ID NO: 7543 - RNA, 21 nt, artificial
  Completely synthesized
uacuuuugggaacaaggaaaa

SEQ ID NO: 7544 - RNA, 21 nt, artificial
  Completely synthesized
uauucacuaggagaauaaggu

SEQ ID NO: 7545 - RNA, 21 nt, artificial
  Completely synthesized
agguuuuccaucuucaucacg

SEQ ID NO: 7546 - RNA, 21 nt, artificial
  Completely synthesized
aaaguagcaggugagggcaug

SEQ ID NO: 7547 - RNA, 21 nt, artificial
  Completely synthesized
cuuuuucuuugagcaauuuuu

SEQ ID NO: 7548 - RNA, 21 nt, artificial
  Completely synthesized
gucuccauagcuggaagauuc

SEQ ID NO: 7549 - RNA, 21 nt, artificial
  Completely synthesized
gcagaauaaaauucaucacca

SEQ ID NO: 7550 - RNA, 21 nt, artificial
  Completely synthesized
gugugucuccauagcuggaag

SEQ ID NO: 7551 - RNA, 21 nt, artificial
  Completely synthesized
ucucaaccagcuugucauuuu

SEQ ID NO: 7552 - RNA, 21 nt, artificial
  Completely synthesized
ugguugaaagcuuugcaaagu

SEQ ID NO: 7553 - RNA, 21 nt, artificial
  Completely synthesized
uaacugagcgaaaaaggcuuu

SEQ ID NO: 7554 - RNA, 21 nt, artificial
  Completely synthesized
uagucucaaccagcuugucau

SEQ ID NO: 7555 - RNA, 21 nt, artificial
  Completely synthesized
agaaauuguuuacaguuaaag

SEQ ID NO: 7556 - RNA, 21 nt, artificial
  Completely synthesized
augacauaagaacaguauaaa

SEQ ID NO: 7557 - RNA, 21 nt, artificial
  Completely synthesized
ucacaucacaguaggagcuuu

SEQ ID NO: 7558 - RNA, 21 nt, artificial
  Completely synthesized
aaggucaaauccuccuaaauc

SEQ ID NO: 7559 - RNA, 21 nt, artificial
  Completely synthesized
cuuacuccaagaucuauaucu

SEQ ID NO: 7560 - RNA, 21 nt, artificial
  Completely synthesized
uagcaaugaagacugggcucu

SEQ ID NO: 7561 - RNA, 21 nt, artificial
  Completely synthesized
ucugucaguuuggcuucugga

SEQ ID NO: 7562 - RNA, 21 nt, artificial
  Completely synthesized
aagcauuaagaaaauguggac

SEQ ID NO: 7563 - RNA, 21 nt, artificial
  Completely synthesized
ucgacuuacuccaagaucuau

SEQ ID NO: 7564 - RNA, 21 nt, artificial
  Completely synthesized
cauucuguuugacacuuccag

SEQ ID NO: 7565 - RNA, 21 nt, artificial
  Completely synthesized
cugaguuguuuuuucaguagg

SEQ ID NO: 7566 - RNA, 21 nt, artificial
  Completely synthesized
caauucugagcagccacuuua

SEQ ID NO: 7567 - RNA, 21 nt, artificial
  Completely synthesized
acuacaguuaccuacuucuuu

SEQ ID NO: 7568 - RNA, 21 nt, artificial
  Completely synthesized
ugucaacuucugucaguuugg

SEQ ID NO: 7569 - RNA, 21 nt, artificial
  Completely synthesized
ugcuguugcugauacugggcu

SEQ ID NO: 7570 - RNA, 21 nt, artificial
  Completely synthesized
auucaacauacugacacucca

SEQ ID NO: 7571 - RNA, 21 nt, artificial
  Completely synthesized
gagcuuuuaguauaauaguac

SEQ ID NO: 7572 - RNA, 21 nt, artificial
  Completely synthesized
uccgucgcugacugaagucaa

SEQ ID NO: 7573 - RNA, 21 nt, artificial
  Completely synthesized
aaaaaacuagcucagaaaagg

SEQ ID NO: 7574 - RNA, 21 nt, artificial
  Completely synthesized
uacuccaagaucuauaucuug

SEQ ID NO: 7575 - RNA, 21 nt, artificial
  Completely synthesized
guucuacuauauuuuccaguu

SEQ ID NO: 7576 - RNA, 21 nt, artificial
  Completely synthesized
cugcucuuuggacaucauuuc

SEQ ID NO: 7577 - RNA, 21 nt, artificial
  Completely synthesized
guugacuguggcaucugaauu

SEQ ID NO: 7578 - RNA, 21 nt, artificial
  Completely synthesized
uccuuuuucuuugagcaauuu

SEQ ID NO: 7579 - RNA, 21 nt, artificial
  Completely synthesized
agagcuuuugcccuaaguuca

SEQ ID NO: 7580 - RNA, 21 nt, artificial
  Completely synthesized
uucaucacguagcaugcugaa

SEQ ID NO: 7581 - RNA, 21 nt, artificial
  Completely synthesized
agcuuugcaaagugauagauc

SEQ ID NO: 7582 - RNA, 21 nt, artificial
  Completely synthesized
uacaggcaauucuuucucugg

SEQ ID NO: 7583 - RNA, 21 nt, artificial
  Completely synthesized
cucaauguccuguugcauacc

SEQ ID NO: 7584 - RNA, 21 nt, artificial
  Completely synthesized
guuaaagugaaacuacugauu

SEQ ID NO: 7585 - RNA, 21 nt, artificial
  Completely synthesized
cagagagugaauggcuuaaag

SEQ ID NO: 7586 - RNA, 21 nt, artificial
  Completely synthesized
ucagaaucacugaggccaagu

SEQ ID NO: 7587 - RNA, 21 nt, artificial
  Completely synthesized
ugggacuuguguuuagugaaa

SEQ ID NO: 7588 - RNA, 21 nt, artificial
  Completely synthesized
aaugccggagucagaaucauu

SEQ ID NO: 7589 - RNA, 21 nt, artificial
  Completely synthesized
uucagagagugaauggcuuaa

SEQ ID NO: 7590 - RNA, 21 nt, artificial
  Completely synthesized
aguuguaacugagcgaaaaag

SEQ ID NO: 7591 - RNA, 21 nt, artificial
  Completely synthesized
accaggacuuacaggcaauuc

SEQ ID NO: 7592 - RNA, 21 nt, artificial
  Completely synthesized
ucagagagugaauggcuuaaa

SEQ ID NO: 7593 - RNA, 21 nt, artificial
  Completely synthesized
uguaacucaggaauggauaau

SEQ ID NO: 7594 - RNA, 21 nt, artificial
  Completely synthesized
cuuuccgucgcugacugaagu

SEQ ID NO: 7595 - RNA, 21 nt, artificial
  Completely synthesized
auucaccugucucuucaucua

SEQ ID NO: 7596 - RNA, 21 nt, artificial
  Completely synthesized
agggagguuaaugauuuuuuc

SEQ ID NO: 7597 - RNA, 21 nt, artificial
  Completely synthesized
ucaucaccaaaaucuguguug

SEQ ID NO: 7598 - RNA, 21 nt, artificial
  Completely synthesized
agcuugucauuuucaauauua

SEQ ID NO: 7599 - RNA, 21 nt, artificial
  Completely synthesized
uuauuaguaccagcucuuaaa

SEQ ID NO: 7600 - RNA, 21 nt, artificial
  Completely synthesized
ucauugaacugcucuuuggac

SEQ ID NO: 7601 - RNA, 21 nt, artificial
  Completely synthesized
uggagagcuuuugcccuaagu

SEQ ID NO: 7602 - RNA, 21 nt, artificial
  Completely synthesized
ugagcaauuuuucuuuuucau

SEQ ID NO: 7603 - RNA, 21 nt, artificial
  Completely synthesized
aguuuucuuuuucugcaauuc

SEQ ID NO: 7604 - RNA, 21 nt, artificial
  Completely synthesized
ugacugaagucaaauacuucu

SEQ ID NO: 7605 - RNA, 21 nt, artificial
  Completely synthesized
aacagaaguuucaggugacug

SEQ ID NO: 7606 - RNA, 21 nt, artificial
  Completely synthesized
ucaaaagcauuaagaaaaugu

SEQ ID NO: 7607 - RNA, 21 nt, artificial
  Completely synthesized
ugauuuugcauagaauuacuu

SEQ ID NO: 7608 - RNA, 21 nt, artificial
  Completely synthesized
guuguucuugucuuuccuuuu

SEQ ID NO: 7609 - RNA, 21 nt, artificial
  Completely synthesized
cucagcuaugaaagcagaaua

SEQ ID NO: 7610 - RNA, 21 nt, artificial
  Completely synthesized
uguccauacaguauuuauaaa

SEQ ID NO: 7611 - RNA, 21 nt, artificial
  Completely synthesized
aauccuccuaaaucuaguuuu

SEQ ID NO: 7612 - RNA, 21 nt, artificial
  Completely synthesized
guagugugucuccauagcugg

SEQ ID NO: 7613 - RNA, 21 nt, artificial
  Completely synthesized
augugaccgggaauaucagga

SEQ ID NO: 7614 - RNA, 21 nt, artificial
  Completely synthesized
aaugacauaagaacaguauaa

SEQ ID NO: 7615 - RNA, 21 nt, artificial
  Completely synthesized
uggaagauuccacugaguguu

SEQ ID NO: 7616 - RNA, 21 nt, artificial
  Completely synthesized
uuucuacagggaaugggauau

SEQ ID NO: 7617 - RNA, 21 nt, artificial
  Completely synthesized
gaaacuacugauucaacauac

SEQ ID NO: 7618 - RNA, 21 nt, artificial
  Completely synthesized
aacugagcgaaaaaggcuuuc

SEQ ID NO: 7619 - RNA, 21 nt, artificial
  Completely synthesized
acugggacuuguguuuaguga

SEQ ID NO: 7620 - RNA, 21 nt, artificial
  Completely synthesized
agaaucauugaauucugcugu

SEQ ID NO: 7621 - RNA, 21 nt, artificial
  Completely synthesized
cuuuucaaguuuuuucuguuu

SEQ ID NO: 7622 - RNA, 21 nt, artificial
  Completely synthesized
gugacugagccugauuaguag

SEQ ID NO: 7623 - RNA, 21 nt, artificial
  Completely synthesized
accugucucuucaucuaguug

SEQ ID NO: 7624 - RNA, 21 nt, artificial
  Completely synthesized
cuucauugaacugcucuuugg

SEQ ID NO: 7625 - RNA, 21 nt, artificial
  Completely synthesized
cuugugagaugagccuccaag

SEQ ID NO: 7626 - RNA, 21 nt, artificial
  Completely synthesized
cuccaagcggcuugaauguuu

SEQ ID NO: 7627 - RNA, 21 nt, artificial
  Completely synthesized
acacagaaacuagcccaaaug

SEQ ID NO: 7628 - RNA, 21 nt, artificial
  Completely synthesized
ugauagaucagaaacaucaau

SEQ ID NO: 7629 - RNA, 21 nt, artificial
  Completely synthesized
ucacguagcaugcugaaaacu

SEQ ID NO: 7630 - RNA, 21 nt, artificial
  Completely synthesized
uagugugucuccauagcugga

SEQ ID NO: 7631 - RNA, 21 nt, artificial
  Completely synthesized
ugaguucacugucaacugguu

SEQ ID NO: 7632 - RNA, 21 nt, artificial
  Completely synthesized
guagucucaaccagcuuguca

SEQ ID NO: 7633 - RNA, 21 nt, artificial
  Completely synthesized
cucagaaaaggucaaauccuc

SEQ ID NO: 7634 - RNA, 21 nt, artificial
  Completely synthesized
ccgaauuaaugcaaguugagc

SEQ ID NO: 7635 - RNA, 21 nt, artificial
  Completely synthesized
agcuuuugcccuaaguucauc

SEQ ID NO: 7636 - RNA, 21 nt, artificial
  Completely synthesized
aaagcuuugcaaagugauaga

SEQ ID NO: 7637 - RNA, 21 nt, artificial
  Completely synthesized
ggguauagaugaguaaaaaug

SEQ ID NO: 7638 - RNA, 21 nt, artificial
  Completely synthesized
guauucacuaggagaauaagg

SEQ ID NO: 7639 - RNA, 21 nt, artificial
  Completely synthesized
cagggagguuaaugauuuuuu

SEQ ID NO: 7640 - RNA, 21 nt, artificial
  Completely synthesized
auucaucaccaaaaucugugu

SEQ ID NO: 7641 - RNA, 21 nt, artificial
  Completely synthesized
ccugucucuucaucuaguugu

SEQ ID NO: 7642 - RNA, 21 nt, artificial
  Completely synthesized
gguuaguuuugcaauaauuuc

SEQ ID NO: 7643 - RNA, 21 nt, artificial
  Completely synthesized
ucuuacuuuugggaacaagga

SEQ ID NO: 7644 - RNA, 21 nt, artificial
  Completely synthesized
cgaauuaaugcaaguugagcu

SEQ ID NO: 7645 - RNA, 21 nt, artificial
  Completely synthesized
augauuuuuucuacagggaau

SEQ ID NO: 7646 - RNA, 21 nt, artificial
  Completely synthesized
acaguuaaagugaaacuacug

SEQ ID NO: 7647 - RNA, 21 nt, artificial
  Completely synthesized
cuucaucuaguuguaacugag

SEQ ID NO: 7648 - RNA, 21 nt, artificial
  Completely synthesized
ucucugguguguucucacauu

SEQ ID NO: 7649 - RNA, 21 nt, artificial
  Completely synthesized
aagucaacaacagggagguua

SEQ ID NO: 7650 - RNA, 21 nt, artificial
  Completely synthesized
ugauacugggcucagcuauga

SEQ ID NO: 7651 - RNA, 21 nt, artificial
  Completely synthesized
acaaggaaaacauugccaucu

SEQ ID NO: 7652 - RNA, 21 nt, artificial
  Completely synthesized
gaaaacauugccaucucuugu

SEQ ID NO: 7653 - RNA, 21 nt, artificial
  Completely synthesized
gcgaaaaaggcuuucucuugc

SEQ ID NO: 7654 - RNA, 21 nt, artificial
  Completely synthesized
ugcaaguugagcuucauugaa

SEQ ID NO: 7655 - RNA, 21 nt, artificial
  Completely synthesized
gaguaguuggcagauccacug

SEQ ID NO: 7656 - RNA, 21 nt, artificial
  Completely synthesized
aguuucaggugacugagccug

SEQ ID NO: 7657 - RNA, 21 nt, artificial
  Completely synthesized
guaguauuuacacuuacacag

SEQ ID NO: 7658 - RNA, 21 nt, artificial
  Completely synthesized
aaguaugucaaucaaauccau

SEQ ID NO: 7659 - RNA, 21 nt, artificial
  Completely synthesized
acauugccaucucuuguuugc

SEQ ID NO: 7660 - RNA, 21 nt, artificial
  Completely synthesized
gcaaguugagcuucauugaac

SEQ ID NO: 7661 - RNA, 21 nt, artificial
  Completely synthesized
cuucuggacuuggaaccaugg

SEQ ID NO: 7662 - RNA, 21 nt, artificial
  Completely synthesized
cuccuuuuucuuugagcaauu

SEQ ID NO: 7663 - RNA, 21 nt, artificial
  Completely synthesized
ucagaaucauugaauucugcu

SEQ ID NO: 7664 - RNA, 21 nt, artificial
  Completely synthesized
agaaacuagcccaaauggugu

SEQ ID NO: 7665 - RNA, 21 nt, artificial
  Completely synthesized
uacugacacuccaaugcuuuu

SEQ ID NO: 7666 - RNA, 23 nt, artificial
  Completely synthesized
gaaaaaacuugaaaaggaaagac

SEQ ID NO: 7667 - RNA, 23 nt, artificial
  Completely synthesized
agaaaaaacuugaaaaggaaaga

SEQ ID NO: 7668 - RNA, 23 nt, artificial
  Completely synthesized
acagaaaaaacuugaaaaggaaa

SEQ ID NO: 7669 - RNA, 23 nt, artificial
  Completely synthesized
aacagaaaaaacuugaaaaggaa

SEQ ID NO: 7670 - RNA, 23 nt, artificial
  Completely synthesized
gaaagaugaaaaagaaaaauugc

SEQ ID NO: 7671 - RNA, 23 nt, artificial
  Completely synthesized
ugaaagaugaaaaagaaaaauug

SEQ ID NO: 7672 - RNA, 23 nt, artificial
  Completely synthesized
uugaaagaugaaaaagaaaaauu

SEQ ID NO: 7673 - RNA, 23 nt, artificial
  Completely synthesized
uuugaaagaugaaaaagaaaaau

SEQ ID NO: 7674 - RNA, 23 nt, artificial
  Completely synthesized
auuugaaagaugaaaaagaaaaa

SEQ ID NO: 7675 - RNA, 23 nt, artificial
  Completely synthesized
ccaaaacuaguauagaaaauaau

SEQ ID NO: 7676 - RNA, 23 nt, artificial
  Completely synthesized
agauuuagaucauuugaaagaug

SEQ ID NO: 7677 - RNA, 23 nt, artificial
  Completely synthesized
aagauuuagaucauuugaaagau

SEQ ID NO: 7678 - RNA, 23 nt, artificial
  Completely synthesized
caagauuuagaucauuugaaaga

SEQ ID NO: 7679 - RNA, 23 nt, artificial
  Completely synthesized
aaguguaaauacuacaaaaacuu

SEQ ID NO: 7680 - RNA, 23 nt, artificial
  Completely synthesized
uaaguguaaauacuacaaaaacu

SEQ ID NO: 7681 - RNA, 23 nt, artificial
  Completely synthesized
guaaguguaaauacuacaaaaac

SEQ ID NO: 7682 - RNA, 23 nt, artificial
  Completely synthesized
uguaaguguaaauacuacaaaaa

SEQ ID NO: 7683 - RNA, 23 nt, artificial
  Completely synthesized
guguaaguguaaauacuacaaaa

SEQ ID NO: 7684 - RNA, 23 nt, artificial
  Completely synthesized
agaaaaauugcucaaagaaaaag

SEQ ID NO: 7685 - RNA, 23 nt, artificial
  Completely synthesized
aagaaaaauugcucaaagaaaaa

SEQ ID NO: 7686 - RNA, 23 nt, artificial
  Completely synthesized
aaagaaaaauugcucaaagaaaa

SEQ ID NO: 7687 - RNA, 23 nt, artificial
  Completely synthesized
aaaagaaaaauugcucaaagaaa

SEQ ID NO: 7688 - RNA, 23 nt, artificial
  Completely synthesized
gaaaaagaaaacuggaaaauaua

SEQ ID NO: 7689 - RNA, 23 nt, artificial
  Completely synthesized
agaaaaagaaaacuggaaaauau

SEQ ID NO: 7690 - RNA, 23 nt, artificial
  Completely synthesized
aaaaauugcucaaagaaaaagga

SEQ ID NO: 7691 - RNA, 23 nt, artificial
  Completely synthesized
gaaauuauugcaaaacuaaccac

SEQ ID NO: 7692 - RNA, 23 nt, artificial
  Completely synthesized
agaaauuauugcaaaacuaacca

SEQ ID NO: 7693 - RNA, 23 nt, artificial
  Completely synthesized
aagaaauuauugcaaaacuaacc

SEQ ID NO: 7694 - RNA, 23 nt, artificial
  Completely synthesized
aaagaaauuauugcaaaacuaac

SEQ ID NO: 7695 - RNA, 23 nt, artificial
  Completely synthesized
aaaagaaauuauugcaaaacuaa

SEQ ID NO: 7696 - RNA, 23 nt, artificial
  Completely synthesized
aacuggaaaauauaguagaacua

SEQ ID NO: 7697 - RNA, 23 nt, artificial
  Completely synthesized
aaacuggaaaauauaguagaacu

SEQ ID NO: 7698 - RNA, 23 nt, artificial
  Completely synthesized
aaaacuggaaaauauaguagaac

SEQ ID NO: 7699 - RNA, 23 nt, artificial
  Completely synthesized
gaaaacuggaaaauauaguagaa

SEQ ID NO: 7700 - RNA, 23 nt, artificial
  Completely synthesized
ggaaaaacagaaaaaacuugaaa

SEQ ID NO: 7701 - RNA, 23 nt, artificial
  Completely synthesized
uggaaaaacagaaaaaacuugaa

SEQ ID NO: 7702 - RNA, 23 nt, artificial
  Completely synthesized
aauacuguauggacaaaaaaugg

SEQ ID NO: 7703 - RNA, 23 nt, artificial
  Completely synthesized
aaauacuguauggacaaaaaaug

SEQ ID NO: 7704 - RNA, 23 nt, artificial
  Completely synthesized
uaaauacuguauggacaaaaaau

SEQ ID NO: 7705 - RNA, 23 nt, artificial
  Completely synthesized
auaaauacuguauggacaaaaaa

SEQ ID NO: 7706 - RNA, 23 nt, artificial
  Completely synthesized
uauaaauacuguauggacaaaaa

SEQ ID NO: 7707 - RNA, 23 nt, artificial
  Completely synthesized
aagaaaacuggaaaauauaguag

SEQ ID NO: 7708 - RNA, 23 nt, artificial
  Completely synthesized
aaagaaaacuggaaaauauagua

SEQ ID NO: 7709 - RNA, 23 nt, artificial
  Completely synthesized
aaaagaaaacuggaaaauauagu

SEQ ID NO: 7710 - RNA, 23 nt, artificial
  Completely synthesized
aaaaagaaaacuggaaaauauag

SEQ ID NO: 7711 - RNA, 23 nt, artificial
  Completely synthesized
aaaaagaaauuauugcaaaacua

SEQ ID NO: 7712 - RNA, 23 nt, artificial
  Completely synthesized
cuguagaaaaaaucauuaaccuc

SEQ ID NO: 7713 - RNA, 23 nt, artificial
  Completely synthesized
caaaaaauggcauuuuuuauauu

SEQ ID NO: 7714 - RNA, 23 nt, artificial
  Completely synthesized
acaaaaaauggcauuuuuuauau

SEQ ID NO: 7715 - RNA, 23 nt, artificial
  Completely synthesized
gacaaaaaauggcauuuuuuaua

SEQ ID NO: 7716 - RNA, 23 nt, artificial
  Completely synthesized
aaaugcucauacuuuauaaguaa

SEQ ID NO: 7717 - RNA, 23 nt, artificial
  Completely synthesized
gaaaugcucauacuuuauaagua

SEQ ID NO: 7718 - RNA, 23 nt, artificial
  Completely synthesized
ugaaaugcucauacuuuauaagu

SEQ ID NO: 7719 - RNA, 23 nt, artificial
  Completely synthesized
cagugucuuaauauugaaaauga

SEQ ID NO: 7720 - RNA, 23 nt, artificial
  Completely synthesized
acagugucuuaauauugaaaaug

SEQ ID NO: 7721 - RNA, 23 nt, artificial
  Completely synthesized
uacagugucuuaauauugaaaau

SEQ ID NO: 7722 - RNA, 23 nt, artificial
  Completely synthesized
uuacagugucuuaauauugaaaa

SEQ ID NO: 7723 - RNA, 23 nt, artificial
  Completely synthesized
guuacagugucuuaauauugaaa

SEQ ID NO: 7724 - RNA, 23 nt, artificial
  Completely synthesized
aguuacagugucuuaauauugaa

SEQ ID NO: 7725 - RNA, 23 nt, artificial
  Completely synthesized
cauuugaaagaugaaaaagaaaa

SEQ ID NO: 7726 - RNA, 23 nt, artificial
  Completely synthesized
ucauuugaaagaugaaaaagaaa

SEQ ID NO: 7727 - RNA, 23 nt, artificial
  Completely synthesized
aucauuugaaagaugaaaaagaa

SEQ ID NO: 7728 - RNA, 23 nt, artificial
  Completely synthesized
gugucuuaauauugaaaaugaca

SEQ ID NO: 7729 - RNA, 23 nt, artificial
  Completely synthesized
agugucuuaauauugaaaaugac

SEQ ID NO: 7730 - RNA, 23 nt, artificial
  Completely synthesized
gcucauacuuuauaaguaauucu

SEQ ID NO: 7731 - RNA, 23 nt, artificial
  Completely synthesized
ugcucauacuuuauaaguaauuc

SEQ ID NO: 7732 - RNA, 23 nt, artificial
  Completely synthesized
augcucauacuuuauaaguaauu

SEQ ID NO: 7733 - RNA, 23 nt, artificial
  Completely synthesized
aaugcucauacuuuauaaguaau

SEQ ID NO: 7734 - RNA, 23 nt, artificial
  Completely synthesized
caaaacuaguauagaaaauaaua

SEQ ID NO: 7735 - RNA, 23 nt, artificial
  Completely synthesized
cacuuuaacuguaaacaauuucu

SEQ ID NO: 7736 - RNA, 23 nt, artificial
  Completely synthesized
ucacuuuaacuguaaacaauuuc

SEQ ID NO: 7737 - RNA, 23 nt, artificial
  Completely synthesized
uucacuuuaacuguaaacaauuu

SEQ ID NO: 7738 - RNA, 23 nt, artificial
  Completely synthesized
uuucacuuuaacuguaaacaauu

SEQ ID NO: 7739 - RNA, 23 nt, artificial
  Completely synthesized
guuucacuuuaacuguaaacaau

SEQ ID NO: 7740 - RNA, 23 nt, artificial
  Completely synthesized
acaaaagacaaacauucaagccg

SEQ ID NO: 7741 - RNA, 23 nt, artificial
  Completely synthesized
aaaacagaaaaaacuugaaaagg

SEQ ID NO: 7742 - RNA, 23 nt, artificial
  Completely synthesized
aaaaacagaaaaaacuugaaaag

SEQ ID NO: 7743 - RNA, 23 nt, artificial
  Completely synthesized
gaaaaacagaaaaaacuugaaaa

SEQ ID NO: 7744 - RNA, 23 nt, artificial
  Completely synthesized
uuuuaagagcugguacuaauaaa

SEQ ID NO: 7745 - RNA, 23 nt, artificial
  Completely synthesized
aaacagaaaaaacuugaaaagga

SEQ ID NO: 7746 - RNA, 23 nt, artificial
  Completely synthesized
caauuaucauuuuuacucaucua

SEQ ID NO: 7747 - RNA, 23 nt, artificial
  Completely synthesized
acaauuaucauuuuuacucaucu

SEQ ID NO: 7748 - RNA, 23 nt, artificial
  Completely synthesized
gacaauuaucauuuuuacucauc

SEQ ID NO: 7749 - RNA, 23 nt, artificial
  Completely synthesized
ugacaauuaucauuuuuacucau

SEQ ID NO: 7750 - RNA, 23 nt, artificial
  Completely synthesized
uugacaauuaucauuuuuacuca

SEQ ID NO: 7751 - RNA, 23 nt, artificial
  Completely synthesized
aaaaagaaaaauugcucaaagaa

SEQ ID NO: 7752 - RNA, 23 nt, artificial
  Completely synthesized
aaaaaacuugaaaaggaaagaca

SEQ ID NO: 7753 - RNA, 23 nt, artificial
  Completely synthesized
auaaguaauucuaugcaaaauca

SEQ ID NO: 7754 - RNA, 23 nt, artificial
  Completely synthesized
uauaaguaauucuaugcaaaauc

SEQ ID NO: 7755 - RNA, 23 nt, artificial
  Completely synthesized
uuauaaguaauucuaugcaaaau

SEQ ID NO: 7756 - RNA, 23 nt, artificial
  Completely synthesized
uuuauaaguaauucuaugcaaaa

SEQ ID NO: 7757 - RNA, 23 nt, artificial
  Completely synthesized
cuuuauaaguaauucuaugcaaa

SEQ ID NO: 7758 - RNA, 23 nt, artificial
  Completely synthesized
gaucauuugaaagaugaaaaaga

SEQ ID NO: 7759 - RNA, 23 nt, artificial
  Completely synthesized
agaucauuugaaagaugaaaaag

SEQ ID NO: 7760 - RNA, 23 nt, artificial
  Completely synthesized
uagaucauuugaaagaugaaaaa

SEQ ID NO: 7761 - RNA, 23 nt, artificial
  Completely synthesized
gaaaaagaaaaauugcucaaaga

SEQ ID NO: 7762 - RNA, 23 nt, artificial
  Completely synthesized
aucaguaguuucacuuuaacugu

SEQ ID NO: 7763 - RNA, 23 nt, artificial
  Completely synthesized
aaucaguaguuucacuuuaacug

SEQ ID NO: 7764 - RNA, 23 nt, artificial
  Completely synthesized
uaaguaauucuaugcaaaaucau

SEQ ID NO: 7765 - RNA, 23 nt, artificial
  Completely synthesized
auacuguauggacaaaaaauggc

SEQ ID NO: 7766 - RNA, 23 nt, artificial
  Completely synthesized
gucuuaauauugaaaaugacaag

SEQ ID NO: 7767 - RNA, 23 nt, artificial
  Completely synthesized
ugucuuaauauugaaaaugacaa

SEQ ID NO: 7768 - RNA, 23 nt, artificial
  Completely synthesized
agauuuuggugaugaauuuuauu

SEQ ID NO: 7769 - RNA, 23 nt, artificial
  Completely synthesized
cagauuuuggugaugaauuuuau

SEQ ID NO: 7770 - RNA, 23 nt, artificial
  Completely synthesized
acagauuuuggugaugaauuuua

SEQ ID NO: 7771 - RNA, 23 nt, artificial
  Completely synthesized
uuagaucauuugaaagaugaaaa

SEQ ID NO: 7772 - RNA, 23 nt, artificial
  Completely synthesized
uuuagaucauuugaaagaugaaa

SEQ ID NO: 7773 - RNA, 23 nt, artificial
  Completely synthesized
auuuagaucauuugaaagaugaa

SEQ ID NO: 7774 - RNA, 23 nt, artificial
  Completely synthesized
cacuauguacuuuuuuauaaaua

SEQ ID NO: 7775 - RNA, 23 nt, artificial
  Completely synthesized
ccacuauguacuuuuuuauaaau

SEQ ID NO: 7776 - RNA, 23 nt, artificial
  Completely synthesized
accacuauguacuuuuuuauaaa

SEQ ID NO: 7777 - RNA, 23 nt, artificial
  Completely synthesized
aaccacuauguacuuuuuuauaa

SEQ ID NO: 7778 - RNA, 23 nt, artificial
  Completely synthesized
uaaccacuauguacuuuuuuaua

SEQ ID NO: 7779 - RNA, 23 nt, artificial
  Completely synthesized
auuuuauucugcuuucauagcug

SEQ ID NO: 7780 - RNA, 23 nt, artificial
  Completely synthesized
aauuuuauucugcuuucauagcu

SEQ ID NO: 7781 - RNA, 23 nt, artificial
  Completely synthesized
ugaauuuuauucugcuuucauag

SEQ ID NO: 7782 - RNA, 23 nt, artificial
  Completely synthesized
augaauuuuauucugcuuucaua

SEQ ID NO: 7783 - RNA, 23 nt, artificial
  Completely synthesized
aguuucacuuuaacuguaaacaa

SEQ ID NO: 7784 - RNA, 23 nt, artificial
  Completely synthesized
ucuggcuaaaaagaaauuauugc

SEQ ID NO: 7785 - RNA, 23 nt, artificial
  Completely synthesized
aucuggcuaaaaagaaauuauug

SEQ ID NO: 7786 - RNA, 23 nt, artificial
  Completely synthesized
uuuuggugaugaauuuuauucug

SEQ ID NO: 7787 - RNA, 23 nt, artificial
  Completely synthesized
auuuuggugaugaauuuuauucu

SEQ ID NO: 7788 - RNA, 23 nt, artificial
  Completely synthesized
gauuuuggugaugaauuuuauuc

SEQ ID NO: 7789 - RNA, 23 nt, artificial
  Completely synthesized
cauuuguuauauucauagauuua

SEQ ID NO: 7790 - RNA, 23 nt, artificial
  Completely synthesized
ucauuuguuauauucauagauuu

SEQ ID NO: 7791 - RNA, 23 nt, artificial
  Completely synthesized
gucauuuguuauauucauagauu

SEQ ID NO: 7792 - RNA, 23 nt, artificial
  Completely synthesized
ugucauuuguuauauucauagau

SEQ ID NO: 7793 - RNA, 23 nt, artificial
  Completely synthesized
augucauuuguuauauucauaga

SEQ ID NO: 7794 - RNA, 23 nt, artificial
  Completely synthesized
cauagauuuauaugaugauauga

SEQ ID NO: 7795 - RNA, 23 nt, artificial
  Completely synthesized
ucauagauuuauaugaugauaug

SEQ ID NO: 7796 - RNA, 23 nt, artificial
  Completely synthesized
uucauagauuuauaugaugauau

SEQ ID NO: 7797 - RNA, 23 nt, artificial
  Completely synthesized
auucauagauuuauaugaugaua

SEQ ID NO: 7798 - RNA, 23 nt, artificial
  Completely synthesized
uauucauagauuuauaugaugau

SEQ ID NO: 7799 - RNA, 23 nt, artificial
  Completely synthesized
cuaaccacuauguacuuuuuuau

SEQ ID NO: 7800 - RNA, 23 nt, artificial
  Completely synthesized
gaugaauuuuauucugcuuucau

SEQ ID NO: 7801 - RNA, 23 nt, artificial
  Completely synthesized
ugaugaauuuuauucugcuuuca

SEQ ID NO: 7802 - RNA, 23 nt, artificial
  Completely synthesized
gauguuaagaaaaacuagauuua

SEQ ID NO: 7803 - RNA, 23 nt, artificial
  Completely synthesized
agauguuaagaaaaacuagauuu

SEQ ID NO: 7804 - RNA, 23 nt, artificial
  Completely synthesized
cagauguuaagaaaaacuagauu

SEQ ID NO: 7805 - RNA, 23 nt, artificial
  Completely synthesized
uuauaaauacuguauggacaaaa

SEQ ID NO: 7806 - RNA, 23 nt, artificial
  Completely synthesized
uuuauaaauacuguauggacaaa

SEQ ID NO: 7807 - RNA, 23 nt, artificial
  Completely synthesized
uuuuauaaauacuguauggacaa

SEQ ID NO: 7808 - RNA, 23 nt, artificial
  Completely synthesized
aguguaaauacuacaaaaacuua

SEQ ID NO: 7809 - RNA, 23 nt, artificial
  Completely synthesized
cuuaauauugaaaaugacaagcu

SEQ ID NO: 7810 - RNA, 23 nt, artificial
  Completely synthesized
ucuuaauauugaaaaugacaagc

SEQ ID NO: 7811 - RNA, 23 nt, artificial
  Completely synthesized
aucauuuuuacucaucuauaccc

SEQ ID NO: 7812 - RNA, 23 nt, artificial
  Completely synthesized
uaucauuuuuacucaucuauacc

SEQ ID NO: 7813 - RNA, 23 nt, artificial
  Completely synthesized
uuaucauuuuuacucaucuauac

SEQ ID NO: 7814 - RNA, 23 nt, artificial
  Completely synthesized
auuaucauuuuuacucaucuaua

SEQ ID NO: 7815 - RNA, 23 nt, artificial
  Completely synthesized
guucuuaugucauuuguuauauu

SEQ ID NO: 7816 - RNA, 23 nt, artificial
  Completely synthesized
uguucuuaugucauuuguuauau

SEQ ID NO: 7817 - RNA, 23 nt, artificial
  Completely synthesized
cuguucuuaugucauuuguuaua

SEQ ID NO: 7818 - RNA, 23 nt, artificial
  Completely synthesized
acuguucuuaugucauuuguuau

SEQ ID NO: 7819 - RNA, 23 nt, artificial
  Completely synthesized
uacuguucuuaugucauuuguua

SEQ ID NO: 7820 - RNA, 23 nt, artificial
  Completely synthesized
ugguacuaauaaaggauuauuau

SEQ ID NO: 7821 - RNA, 23 nt, artificial
  Completely synthesized
cugguacuaauaaaggauuauua

SEQ ID NO: 7822 - RNA, 23 nt, artificial
  Completely synthesized
uuuuuauaaauacuguauggaca

SEQ ID NO: 7823 - RNA, 23 nt, artificial
  Completely synthesized
acuuuauaaguaauucuaugcaa

SEQ ID NO: 7824 - RNA, 23 nt, artificial
  Completely synthesized
agaaaacuggaaaauauaguaga

SEQ ID NO: 7825 - RNA, 23 nt, artificial
  Completely synthesized
ugaaaaagaaaaauugcucaaag

SEQ ID NO: 7826 - RNA, 23 nt, artificial
  Completely synthesized
augaaaaagaaaaauugcucaaa

SEQ ID NO: 7827 - RNA, 23 nt, artificial
  Completely synthesized
gaugaaaaagaaaaauugcucaa

SEQ ID NO: 7828 - RNA, 23 nt, artificial
  Completely synthesized
agaugaaaaagaaaaauugcuca

SEQ ID NO: 7829 - RNA, 23 nt, artificial
  Completely synthesized
uggcuaaaaagaaauuauugcaa

SEQ ID NO: 7830 - RNA, 23 nt, artificial
  Completely synthesized
uguguaaguguaaauacuacaaa

SEQ ID NO: 7831 - RNA, 23 nt, artificial
  Completely synthesized
uaguuucacuuuaacuguaaaca

SEQ ID NO: 7832 - RNA, 23 nt, artificial
  Completely synthesized
aguaguuucacuuuaacuguaaa

SEQ ID NO: 7833 - RNA, 23 nt, artificial
  Completely synthesized
acuaaccacuauguacuuuuuua

SEQ ID NO: 7834 - RNA, 23 nt, artificial
  Completely synthesized
uaagaaaaacuagauuuaggagg

SEQ ID NO: 7835 - RNA, 23 nt, artificial
  Completely synthesized
uuaagaaaaacuagauuuaggag

SEQ ID NO: 7836 - RNA, 23 nt, artificial
  Completely synthesized
guuaagaaaaacuagauuuagga

SEQ ID NO: 7837 - RNA, 23 nt, artificial
  Completely synthesized
gaaaauaauacgaaacuuuaaaa

SEQ ID NO: 7838 - RNA, 23 nt, artificial
  Completely synthesized
agaaaauaauacgaaacuuuaaa

SEQ ID NO: 7839 - RNA, 23 nt, artificial
  Completely synthesized
uagaaaauaauacgaaacuuuaa

SEQ ID NO: 7840 - RNA, 23 nt, artificial
  Completely synthesized
auagaaaauaauacgaaacuuua

SEQ ID NO: 7841 - RNA, 23 nt, artificial
  Completely synthesized
uauagaaaauaauacgaaacuuu

SEQ ID NO: 7842 - RNA, 23 nt, artificial
  Completely synthesized
uuggugaugaauuuuauucugcu

SEQ ID NO: 7843 - RNA, 23 nt, artificial
  Completely synthesized
uacgaaacuuuaaaaagcauugg

SEQ ID NO: 7844 - RNA, 23 nt, artificial
  Completely synthesized
auacgaaacuuuaaaaagcauug

SEQ ID NO: 7845 - RNA, 23 nt, artificial
  Completely synthesized
aauacgaaacuuuaaaaagcauu

SEQ ID NO: 7846 - RNA, 23 nt, artificial
  Completely synthesized
uaauacgaaacuuuaaaaagcau

SEQ ID NO: 7847 - RNA, 23 nt, artificial
  Completely synthesized
ugaacucauuaaauucagaugcc

SEQ ID NO: 7848 - RNA, 23 nt, artificial
  Completely synthesized
gugaacucauuaaauucagaugc

SEQ ID NO: 7849 - RNA, 23 nt, artificial
  Completely synthesized
caguucaaugaagcucaacuugc

SEQ ID NO: 7850 - RNA, 23 nt, artificial
  Completely synthesized
aauuaucauuuuuacucaucuau

SEQ ID NO: 7851 - RNA, 23 nt, artificial
  Completely synthesized
agaaguugacaauuaucauuuuu

SEQ ID NO: 7852 - RNA, 23 nt, artificial
  Completely synthesized
cagaaguugacaauuaucauuuu

SEQ ID NO: 7853 - RNA, 23 nt, artificial
  Completely synthesized
acagaaguugacaauuaucauuu

SEQ ID NO: 7854 - RNA, 23 nt, artificial
  Completely synthesized
cuaaaaagaaauuauugcaaaac

SEQ ID NO: 7855 - RNA, 23 nt, artificial
  Completely synthesized
gcuaaaaagaaauuauugcaaaa

SEQ ID NO: 7856 - RNA, 23 nt, artificial
  Completely synthesized
ggcuaaaaagaaauuauugcaaa

SEQ ID NO: 7857 - RNA, 23 nt, artificial
  Completely synthesized
uaugucauuuguuauauucauag

SEQ ID NO: 7858 - RNA, 23 nt, artificial
  Completely synthesized
uuaugucauuuguuauauucaua

SEQ ID NO: 7859 - RNA, 23 nt, artificial
  Completely synthesized
cuuaugucauuuguuauauucau

SEQ ID NO: 7860 - RNA, 23 nt, artificial
  Completely synthesized
aguugacaauuaucauuuuuacu

SEQ ID NO: 7861 - RNA, 23 nt, artificial
  Completely synthesized
aaguugacaauuaucauuuuuac

SEQ ID NO: 7862 - RNA, 23 nt, artificial
  Completely synthesized
gaaguugacaauuaucauuuuua

SEQ ID NO: 7863 - RNA, 23 nt, artificial
  Completely synthesized
gguacuaauaaaggauuauuaug

SEQ ID NO: 7864 - RNA, 23 nt, artificial
  Completely synthesized
acuuauuuauacuguucuuaugu

SEQ ID NO: 7865 - RNA, 23 nt, artificial
  Completely synthesized
aacuuauuuauacuguucuuaug

SEQ ID NO: 7866 - RNA, 23 nt, artificial
  Completely synthesized
aaacuuauuuauacuguucuuau

SEQ ID NO: 7867 - RNA, 23 nt, artificial
  Completely synthesized
aaaacuuauuuauacuguucuua

SEQ ID NO: 7868 - RNA, 23 nt, artificial
  Completely synthesized
aaaaacuuauuuauacuguucuu

SEQ ID NO: 7869 - RNA, 23 nt, artificial
  Completely synthesized
uaguccacauuuucuuaaugcuu

SEQ ID NO: 7870 - RNA, 23 nt, artificial
  Completely synthesized
uuuauaugaugauaugacaucug

SEQ ID NO: 7871 - RNA, 23 nt, artificial
  Completely synthesized
auuuauaugaugauaugacaucu

SEQ ID NO: 7872 - RNA, 23 nt, artificial
  Completely synthesized
gauuuauaugaugauaugacauc

SEQ ID NO: 7873 - RNA, 23 nt, artificial
  Completely synthesized
agauuuauaugaugauaugacau

SEQ ID NO: 7874 - RNA, 23 nt, artificial
  Completely synthesized
uagauuuauaugaugauaugaca

SEQ ID NO: 7875 - RNA, 23 nt, artificial
  Completely synthesized
auagauuuauaugaugauaugac

SEQ ID NO: 7876 - RNA, 23 nt, artificial
  Completely synthesized
guauagaaaauaauacgaaacuu

SEQ ID NO: 7877 - RNA, 23 nt, artificial
  Completely synthesized
aguauagaaaauaauacgaaacu

SEQ ID NO: 7878 - RNA, 23 nt, artificial
  Completely synthesized
uaguauagaaaauaauacgaaac

SEQ ID NO: 7879 - RNA, 23 nt, artificial
  Completely synthesized
cuaguauagaaaauaauacgaaa

SEQ ID NO: 7880 - RNA, 23 nt, artificial
  Completely synthesized
acuaguauagaaaauaauacgaa

SEQ ID NO: 7881 - RNA, 23 nt, artificial
  Completely synthesized
guaaacaauuucuuaggacacca

SEQ ID NO: 7882 - RNA, 23 nt, artificial
  Completely synthesized
uguaaacaauuucuuaggacacc

SEQ ID NO: 7883 - RNA, 23 nt, artificial
  Completely synthesized
aagaugaaaaagaaaaauugcuc

SEQ ID NO: 7884 - RNA, 23 nt, artificial
  Completely synthesized
aaagaugaaaaagaaaaauugcu

SEQ ID NO: 7885 - RNA, 23 nt, artificial
  Completely synthesized
aaaaucauagccaaaacuaguau

SEQ ID NO: 7886 - RNA, 23 nt, artificial
  Completely synthesized
gucuuuccuuuucaaguuuuuuc

SEQ ID NO: 7887 - RNA, 23 nt, artificial
  Completely synthesized
ucuuuccuuuucaaguuuuuucu

SEQ ID NO: 7888 - RNA, 23 nt, artificial
  Completely synthesized
uuuccuuuucaaguuuuuucugu

SEQ ID NO: 7889 - RNA, 23 nt, artificial
  Completely synthesized
uuccuuuucaaguuuuuucuguu

SEQ ID NO: 7890 - RNA, 23 nt, artificial
  Completely synthesized
gcaauuuuucuuuuucaucuuuc

SEQ ID NO: 7891 - RNA, 23 nt, artificial
  Completely synthesized
caauuuuucuuuuucaucuuuca

SEQ ID NO: 7892 - RNA, 23 nt, artificial
  Completely synthesized
aauuuuucuuuuucaucuuucaa

SEQ ID NO: 7893 - RNA, 23 nt, artificial
  Completely synthesized
auuuuucuuuuucaucuuucaaa

SEQ ID NO: 7894 - RNA, 23 nt, artificial
  Completely synthesized
uuuuucuuuuucaucuuucaaau

SEQ ID NO: 7895 - RNA, 23 nt, artificial
  Completely synthesized
auuauuuucuauacuaguuuugg

SEQ ID NO: 7896 - RNA, 23 nt, artificial
  Completely synthesized
caucuuucaaaugaucuaaaucu

SEQ ID NO: 7897 - RNA, 23 nt, artificial
  Completely synthesized
aucuuucaaaugaucuaaaucuu

SEQ ID NO: 7898 - RNA, 23 nt, artificial
  Completely synthesized
ucuuucaaaugaucuaaaucuug

SEQ ID NO: 7899 - RNA, 23 nt, artificial
  Completely synthesized
aaguuuuuguaguauuuacacuu

SEQ ID NO: 7900 - RNA, 23 nt, artificial
  Completely synthesized
aguuuuuguaguauuuacacuua

SEQ ID NO: 7901 - RNA, 23 nt, artificial
  Completely synthesized
guuuuuguaguauuuacacuuac

SEQ ID NO: 7902 - RNA, 23 nt, artificial
  Completely synthesized
uuuuuguaguauuuacacuuaca

SEQ ID NO: 7903 - RNA, 23 nt, artificial
  Completely synthesized
uuuuguaguauuuacacuuacac

SEQ ID NO: 7904 - RNA, 23 nt, artificial
  Completely synthesized
cuuuuucuuugagcaauuuuucu

SEQ ID NO: 7905 - RNA, 23 nt, artificial
  Completely synthesized
uuuuucuuugagcaauuuuucuu

SEQ ID NO: 7906 - RNA, 23 nt, artificial
  Completely synthesized
uuuucuuugagcaauuuuucuuu

SEQ ID NO: 7907 - RNA, 23 nt, artificial
  Completely synthesized
uuucuuugagcaauuuuucuuuu

SEQ ID NO: 7908 - RNA, 23 nt, artificial
  Completely synthesized
uauauuuuccaguuuucuuuuuc

SEQ ID NO: 7909 - RNA, 23 nt, artificial
  Completely synthesized
auauuuuccaguuuucuuuuucu

SEQ ID NO: 7910 - RNA, 23 nt, artificial
  Completely synthesized
uccuuuuucuuugagcaauuuuu

SEQ ID NO: 7911 - RNA, 23 nt, artificial
  Completely synthesized
gugguuaguuuugcaauaauuuc

SEQ ID NO: 7912 - RNA, 23 nt, artificial
  Completely synthesized
ugguuaguuuugcaauaauuucu

SEQ ID NO: 7913 - RNA, 23 nt, artificial
  Completely synthesized
gguuaguuuugcaauaauuucuu

SEQ ID NO: 7914 - RNA, 23 nt, artificial
  Completely synthesized
guuaguuuugcaauaauuucuuu

SEQ ID NO: 7915 - RNA, 23 nt, artificial
  Completely synthesized
uuaguuuugcaauaauuucuuuu

SEQ ID NO: 7916 - RNA, 23 nt, artificial
  Completely synthesized
uaguucuacuauauuuuccaguu

SEQ ID NO: 7917 - RNA, 23 nt, artificial
  Completely synthesized
aguucuacuauauuuuccaguuu

SEQ ID NO: 7918 - RNA, 23 nt, artificial
  Completely synthesized
guucuacuauauuuuccaguuuu

SEQ ID NO: 7919 - RNA, 23 nt, artificial
  Completely synthesized
uucuacuauauuuuccaguuuuc

SEQ ID NO: 7920 - RNA, 23 nt, artificial
  Completely synthesized
uuucaaguuuuuucuguuuuucc

SEQ ID NO: 7921 - RNA, 23 nt, artificial
  Completely synthesized
uucaaguuuuuucuguuuuucca

SEQ ID NO: 7922 - RNA, 23 nt, artificial
  Completely synthesized
ccauuuuuuguccauacaguauu

SEQ ID NO: 7923 - RNA, 23 nt, artificial
  Completely synthesized
cauuuuuuguccauacaguauuu

SEQ ID NO: 7924 - RNA, 23 nt, artificial
  Completely synthesized
auuuuuuguccauacaguauuua

SEQ ID NO: 7925 - RNA, 23 nt, artificial
  Completely synthesized
uuuuuuguccauacaguauuuau

SEQ ID NO: 7926 - RNA, 23 nt, artificial
  Completely synthesized
uuuuuguccauacaguauuuaua

SEQ ID NO: 7927 - RNA, 23 nt, artificial
  Completely synthesized
cuacuauauuuuccaguuuucuu

SEQ ID NO: 7928 - RNA, 23 nt, artificial
  Completely synthesized
uacuauauuuuccaguuuucuuu

SEQ ID NO: 7929 - RNA, 23 nt, artificial
  Completely synthesized
acuauauuuuccaguuuucuuuu

SEQ ID NO: 7930 - RNA, 23 nt, artificial
  Completely synthesized
cuauauuuuccaguuuucuuuuu

SEQ ID NO: 7931 - RNA, 23 nt, artificial
  Completely synthesized
uaguuuugcaauaauuucuuuuu

SEQ ID NO: 7932 - RNA, 23 nt, artificial
  Completely synthesized
gagguuaaugauuuuuucuacag

SEQ ID NO: 7933 - RNA, 23 nt, artificial
  Completely synthesized
aauauaaaaaaugccauuuuuug

SEQ ID NO: 7934 - RNA, 23 nt, artificial
  Completely synthesized
auauaaaaaaugccauuuuuugu

SEQ ID NO: 7935 - RNA, 23 nt, artificial
  Completely synthesized
uauaaaaaaugccauuuuuuguc

SEQ ID NO: 7936 - RNA, 23 nt, artificial
  Completely synthesized
uuacuuauaaaguaugagcauuu

SEQ ID NO: 7937 - RNA, 23 nt, artificial
  Completely synthesized
uacuuauaaaguaugagcauuuc

SEQ ID NO: 7938 - RNA, 23 nt, artificial
  Completely synthesized
acuuauaaaguaugagcauuuca

SEQ ID NO: 7939 - RNA, 23 nt, artificial
  Completely synthesized
ucauuuucaauauuaagacacug

SEQ ID NO: 7940 - RNA, 23 nt, artificial
  Completely synthesized
cauuuucaauauuaagacacugu

SEQ ID NO: 7941 - RNA, 23 nt, artificial
  Completely synthesized
auuuucaauauuaagacacugua

SEQ ID NO: 7942 - RNA, 23 nt, artificial
  Completely synthesized
uuuucaauauuaagacacuguaa

SEQ ID NO: 7943 - RNA, 23 nt, artificial
  Completely synthesized
uuucaauauuaagacacuguaac

SEQ ID NO: 7944 - RNA, 23 nt, artificial
  Completely synthesized
uucaauauuaagacacuguaacu

SEQ ID NO: 7945 - RNA, 23 nt, artificial
  Completely synthesized
uuuucuuuuucaucuuucaaaug

SEQ ID NO: 7946 - RNA, 23 nt, artificial
  Completely synthesized
uuucuuuuucaucuuucaaauga

SEQ ID NO: 7947 - RNA, 23 nt, artificial
  Completely synthesized
uucuuuuucaucuuucaaaugau

SEQ ID NO: 7948 - RNA, 23 nt, artificial
  Completely synthesized
ugucauuuucaauauuaagacac

SEQ ID NO: 7949 - RNA, 23 nt, artificial
  Completely synthesized
gucauuuucaauauuaagacacu

SEQ ID NO: 7950 - RNA, 23 nt, artificial
  Completely synthesized
agaauuacuuauaaaguaugagc

SEQ ID NO: 7951 - RNA, 23 nt, artificial
  Completely synthesized
gaauuacuuauaaaguaugagca

SEQ ID NO: 7952 - RNA, 23 nt, artificial
  Completely synthesized
aauuacuuauaaaguaugagcau

SEQ ID NO: 7953 - RNA, 23 nt, artificial
  Completely synthesized
auuacuuauaaaguaugagcauu

SEQ ID NO: 7954 - RNA, 23 nt, artificial
  Completely synthesized
uauuauuuucuauacuaguuuug

SEQ ID NO: 7955 - RNA, 23 nt, artificial
  Completely synthesized
agaaauuguuuacaguuaaagug

SEQ ID NO: 7956 - RNA, 23 nt, artificial
  Completely synthesized
gaaauuguuuacaguuaaaguga

SEQ ID NO: 7957 - RNA, 23 nt, artificial
  Completely synthesized
aaauuguuuacaguuaaagugaa

SEQ ID NO: 7958 - RNA, 23 nt, artificial
  Completely synthesized
aauuguuuacaguuaaagugaaa

SEQ ID NO: 7959 - RNA, 23 nt, artificial
  Completely synthesized
auuguuuacaguuaaagugaaac

SEQ ID NO: 7960 - RNA, 23 nt, artificial
  Completely synthesized
cggcuugaauguuugucuuuugu

SEQ ID NO: 7961 - RNA, 23 nt, artificial
  Completely synthesized
ccuuuucaaguuuuuucuguuuu

SEQ ID NO: 7962 - RNA, 23 nt, artificial
  Completely synthesized
cuuuucaaguuuuuucuguuuuu

SEQ ID NO: 7963 - RNA, 23 nt, artificial
  Completely synthesized
uuuucaaguuuuuucuguuuuuc

SEQ ID NO: 7964 - RNA, 23 nt, artificial
  Completely synthesized
uuuauuaguaccagcucuuaaaa

SEQ ID NO: 7965 - RNA, 23 nt, artificial
  Completely synthesized
uccuuuucaaguuuuuucuguuu

SEQ ID NO: 7966 - RNA, 23 nt, artificial
  Completely synthesized
uagaugaguaaaaaugauaauug

SEQ ID NO: 7967 - RNA, 23 nt, artificial
  Completely synthesized
agaugaguaaaaaugauaauugu

SEQ ID NO: 7968 - RNA, 23 nt, artificial
  Completely synthesized
gaugaguaaaaaugauaauuguc

SEQ ID NO: 7969 - RNA, 23 nt, artificial
  Completely synthesized
augaguaaaaaugauaauuguca

SEQ ID NO: 7970 - RNA, 23 nt, artificial
  Completely synthesized
ugaguaaaaaugauaauugucaa

SEQ ID NO: 7971 - RNA, 23 nt, artificial
  Completely synthesized
uucuuugagcaauuuuucuuuuu

SEQ ID NO: 7972 - RNA, 23 nt, artificial
  Completely synthesized
ugucuuuccuuuucaaguuuuuu

SEQ ID NO: 7973 - RNA, 23 nt, artificial
  Completely synthesized
ugauuuugcauagaauuacuuau

SEQ ID NO: 7974 - RNA, 23 nt, artificial
  Completely synthesized
gauuuugcauagaauuacuuaua

SEQ ID NO: 7975 - RNA, 23 nt, artificial
  Completely synthesized
auuuugcauagaauuacuuauaa

SEQ ID NO: 7976 - RNA, 23 nt, artificial
  Completely synthesized
uuuugcauagaauuacuuauaaa

SEQ ID NO: 7977 - RNA, 23 nt, artificial
  Completely synthesized
uuugcauagaauuacuuauaaag

SEQ ID NO: 7978 - RNA, 23 nt, artificial
  Completely synthesized
ucuuuuucaucuuucaaaugauc

SEQ ID NO: 7979 - RNA, 23 nt, artificial
  Completely synthesized
cuuuuucaucuuucaaaugaucu

SEQ ID NO: 7980 - RNA, 23 nt, artificial
  Completely synthesized
uuuuucaucuuucaaaugaucua

SEQ ID NO: 7981 - RNA, 23 nt, artificial
  Completely synthesized
ucuuugagcaauuuuucuuuuuc

SEQ ID NO: 7982 - RNA, 23 nt, artificial
  Completely synthesized
acaguuaaagugaaacuacugau

SEQ ID NO: 7983 - RNA, 23 nt, artificial
  Completely synthesized
caguuaaagugaaacuacugauu

SEQ ID NO: 7984 - RNA, 23 nt, artificial
  Completely synthesized
augauuuugcauagaauuacuua

SEQ ID NO: 7985 - RNA, 23 nt, artificial
  Completely synthesized
gccauuuuuuguccauacaguau

SEQ ID NO: 7986 - RNA, 23 nt, artificial
  Completely synthesized
cuugucauuuucaauauuaagac

SEQ ID NO: 7987 - RNA, 23 nt, artificial
  Completely synthesized
uugucauuuucaauauuaagaca

SEQ ID NO: 7988 - RNA, 23 nt, artificial
  Completely synthesized
aauaaaauucaucaccaaaaucu

SEQ ID NO: 7989 - RNA, 23 nt, artificial
  Completely synthesized
auaaaauucaucaccaaaaucug

SEQ ID NO: 7990 - RNA, 23 nt, artificial
  Completely synthesized
uaaaauucaucaccaaaaucugu

SEQ ID NO: 7991 - RNA, 23 nt, artificial
  Completely synthesized
uuuucaucuuucaaaugaucuaa

SEQ ID NO: 7992 - RNA, 23 nt, artificial
  Completely synthesized
uuucaucuuucaaaugaucuaaa

SEQ ID NO: 7993 - RNA, 23 nt, artificial
  Completely synthesized
uucaucuuucaaaugaucuaaau

SEQ ID NO: 7994 - RNA, 23 nt, artificial
  Completely synthesized
uauuuauaaaaaaguacauagug

SEQ ID NO: 7995 - RNA, 23 nt, artificial
  Completely synthesized
auuuauaaaaaaguacauagugg

SEQ ID NO: 7996 - RNA, 23 nt, artificial
  Completely synthesized
uuuauaaaaaaguacauaguggu

SEQ ID NO: 7997 - RNA, 23 nt, artificial
  Completely synthesized
uuauaaaaaaguacauagugguu

SEQ ID NO: 7998 - RNA, 23 nt, artificial
  Completely synthesized
uauaaaaaaguacauagugguua

SEQ ID NO: 7999 - RNA, 23 nt, artificial
  Completely synthesized
cagcuaugaaagcagaauaaaau

SEQ ID NO: 8000 - RNA, 23 nt, artificial
  Completely synthesized
agcuaugaaagcagaauaaaauu

SEQ ID NO: 8001 - RNA, 23 nt, artificial
  Completely synthesized
cuaugaaagcagaauaaaauuca

SEQ ID NO: 8002 - RNA, 23 nt, artificial
  Completely synthesized
uaugaaagcagaauaaaauucau

SEQ ID NO: 8003 - RNA, 23 nt, artificial
  Completely synthesized
uuguuuacaguuaaagugaaacu

SEQ ID NO: 8004 - RNA, 23 nt, artificial
  Completely synthesized
gcaauaauuucuuuuuagccaga

SEQ ID NO: 8005 - RNA, 23 nt, artificial
  Completely synthesized
caauaauuucuuuuuagccagau

SEQ ID NO: 8006 - RNA, 23 nt, artificial
  Completely synthesized
cagaauaaaauucaucaccaaaa

SEQ ID NO: 8007 - RNA, 23 nt, artificial
  Completely synthesized
agaauaaaauucaucaccaaaau

SEQ ID NO: 8008 - RNA, 23 nt, artificial
  Completely synthesized
gaauaaaauucaucaccaaaauc

SEQ ID NO: 8009 - RNA, 23 nt, artificial
  Completely synthesized
uaaaucuaugaauauaacaaaug

SEQ ID NO: 8010 - RNA, 23 nt, artificial
  Completely synthesized
aaaucuaugaauauaacaaauga

SEQ ID NO: 8011 - RNA, 23 nt, artificial
  Completely synthesized
aaucuaugaauauaacaaaugac

SEQ ID NO: 8012 - RNA, 23 nt, artificial
  Completely synthesized
aucuaugaauauaacaaaugaca

SEQ ID NO: 8013 - RNA, 23 nt, artificial
  Completely synthesized
ucuaugaauauaacaaaugacau

SEQ ID NO: 8014 - RNA, 23 nt, artificial
  Completely synthesized
ucauaucaucauauaaaucuaug

SEQ ID NO: 8015 - RNA, 23 nt, artificial
  Completely synthesized
cauaucaucauauaaaucuauga

SEQ ID NO: 8016 - RNA, 23 nt, artificial
  Completely synthesized
auaucaucauauaaaucuaugaa

SEQ ID NO: 8017 - RNA, 23 nt, artificial
  Completely synthesized
uaucaucauauaaaucuaugaau

SEQ ID NO: 8018 - RNA, 23 nt, artificial
  Completely synthesized
aucaucauauaaaucuaugaaua

SEQ ID NO: 8019 - RNA, 23 nt, artificial
  Completely synthesized
auaaaaaaguacauagugguuag

SEQ ID NO: 8020 - RNA, 23 nt, artificial
  Completely synthesized
augaaagcagaauaaaauucauc

SEQ ID NO: 8021 - RNA, 23 nt, artificial
  Completely synthesized
ugaaagcagaauaaaauucauca

SEQ ID NO: 8022 - RNA, 23 nt, artificial
  Completely synthesized
uaaaucuaguuuuucuuaacauc

SEQ ID NO: 8023 - RNA, 23 nt, artificial
  Completely synthesized
aaaucuaguuuuucuuaacaucu

SEQ ID NO: 8024 - RNA, 23 nt, artificial
  Completely synthesized
aaucuaguuuuucuuaacaucug

SEQ ID NO: 8025 - RNA, 23 nt, artificial
  Completely synthesized
uuuuguccauacaguauuuauaa

SEQ ID NO: 8026 - RNA, 23 nt, artificial
  Completely synthesized
uuuguccauacaguauuuauaaa

SEQ ID NO: 8027 - RNA, 23 nt, artificial
  Completely synthesized
uuguccauacaguauuuauaaaa

SEQ ID NO: 8028 - RNA, 23 nt, artificial
  Completely synthesized
uaaguuuuuguaguauuuacacu

SEQ ID NO: 8029 - RNA, 23 nt, artificial
  Completely synthesized
agcuugucauuuucaauauuaag

SEQ ID NO: 8030 - RNA, 23 nt, artificial
  Completely synthesized
gcuugucauuuucaauauuaaga

SEQ ID NO: 8031 - RNA, 23 nt, artificial
  Completely synthesized
ggguauagaugaguaaaaaugau

SEQ ID NO: 8032 - RNA, 23 nt, artificial
  Completely synthesized
gguauagaugaguaaaaaugaua

SEQ ID NO: 8033 - RNA, 23 nt, artificial
  Completely synthesized
guauagaugaguaaaaaugauaa

SEQ ID NO: 8034 - RNA, 23 nt, artificial
  Completely synthesized
uauagaugaguaaaaaugauaau

SEQ ID NO: 8035 - RNA, 23 nt, artificial
  Completely synthesized
aauauaacaaaugacauaagaac

SEQ ID NO: 8036 - RNA, 23 nt, artificial
  Completely synthesized
auauaacaaaugacauaagaaca

SEQ ID NO: 8037 - RNA, 23 nt, artificial
  Completely synthesized
uauaacaaaugacauaagaacag

SEQ ID NO: 8038 - RNA, 23 nt, artificial
  Completely synthesized
auaacaaaugacauaagaacagu

SEQ ID NO: 8039 - RNA, 23 nt, artificial
  Completely synthesized
uaacaaaugacauaagaacagua

SEQ ID NO: 8040 - RNA, 23 nt, artificial
  Completely synthesized
auaauaauccuuuauuaguacca

SEQ ID NO: 8041 - RNA, 23 nt, artificial
  Completely synthesized
uaauaauccuuuauuaguaccag

SEQ ID NO: 8042 - RNA, 23 nt, artificial
  Completely synthesized
uguccauacaguauuuauaaaaa

SEQ ID NO: 8043 - RNA, 23 nt, artificial
  Completely synthesized
uugcauagaauuacuuauaaagu

SEQ ID NO: 8044 - RNA, 23 nt, artificial
  Completely synthesized
ucuacuauauuuuccaguuuucu

SEQ ID NO: 8045 - RNA, 23 nt, artificial
  Completely synthesized
cuuugagcaauuuuucuuuuuca

SEQ ID NO: 8046 - RNA, 23 nt, artificial
  Completely synthesized
uuugagcaauuuuucuuuuucau

SEQ ID NO: 8047 - RNA, 23 nt, artificial
  Completely synthesized
uugagcaauuuuucuuuuucauc

SEQ ID NO: 8048 - RNA, 23 nt, artificial
  Completely synthesized
ugagcaauuuuucuuuuucaucu

SEQ ID NO: 8049 - RNA, 23 nt, artificial
  Completely synthesized
uugcaauaauuucuuuuuagcca

SEQ ID NO: 8050 - RNA, 23 nt, artificial
  Completely synthesized
uuuguaguauuuacacuuacaca

SEQ ID NO: 8051 - RNA, 23 nt, artificial
  Completely synthesized
uguuuacaguuaaagugaaacua

SEQ ID NO: 8052 - RNA, 23 nt, artificial
  Completely synthesized
uuuacaguuaaagugaaacuacu

SEQ ID NO: 8053 - RNA, 23 nt, artificial
  Completely synthesized
uaaaaaaguacauagugguuagu

SEQ ID NO: 8054 - RNA, 23 nt, artificial
  Completely synthesized
ccuccuaaaucuaguuuuucuua

SEQ ID NO: 8055 - RNA, 23 nt, artificial
  Completely synthesized
cuccuaaaucuaguuuuucuuaa

SEQ ID NO: 8056 - RNA, 23 nt, artificial
  Completely synthesized
uccuaaaucuaguuuuucuuaac

SEQ ID NO: 8057 - RNA, 23 nt, artificial
  Completely synthesized
uuuuaaaguuucguauuauuuuc

SEQ ID NO: 8058 - RNA, 23 nt, artificial
  Completely synthesized
uuuaaaguuucguauuauuuucu

SEQ ID NO: 8059 - RNA, 23 nt, artificial
  Completely synthesized
uuaaaguuucguauuauuuucua

SEQ ID NO: 8060 - RNA, 23 nt, artificial
  Completely synthesized
uaaaguuucguauuauuuucuau

SEQ ID NO: 8061 - RNA, 23 nt, artificial
  Completely synthesized
aaaguuucguauuauuuucuaua

SEQ ID NO: 8062 - RNA, 23 nt, artificial
  Completely synthesized
agcagaauaaaauucaucaccaa

SEQ ID NO: 8063 - RNA, 23 nt, artificial
  Completely synthesized
ccaaugcuuuuuaaaguuucgua

SEQ ID NO: 8064 - RNA, 23 nt, artificial
  Completely synthesized
caaugcuuuuuaaaguuucguau

SEQ ID NO: 8065 - RNA, 23 nt, artificial
  Completely synthesized
aaugcuuuuuaaaguuucguauu

SEQ ID NO: 8066 - RNA, 23 nt, artificial
  Completely synthesized
augcuuuuuaaaguuucguauua

SEQ ID NO: 8067 - RNA, 23 nt, artificial
  Completely synthesized
ggcaucugaauuuaaugaguuca

SEQ ID NO: 8068 - RNA, 23 nt, artificial
  Completely synthesized
gcaucugaauuuaaugaguucac

SEQ ID NO: 8069 - RNA, 23 nt, artificial
  Completely synthesized
gcaaguugagcuucauugaacug

SEQ ID NO: 8070 - RNA, 23 nt, artificial
  Completely synthesized
auagaugaguaaaaaugauaauu

SEQ ID NO: 8071 - RNA, 23 nt, artificial
  Completely synthesized
aaaaaugauaauugucaacuucu

SEQ ID NO: 8072 - RNA, 23 nt, artificial
  Completely synthesized
aaaaugauaauugucaacuucug

SEQ ID NO: 8073 - RNA, 23 nt, artificial
  Completely synthesized
aaaugauaauugucaacuucugu

SEQ ID NO: 8074 - RNA, 23 nt, artificial
  Completely synthesized
guuuugcaauaauuucuuuuuag

SEQ ID NO: 8075 - RNA, 23 nt, artificial
  Completely synthesized
uuuugcaauaauuucuuuuuagc

SEQ ID NO: 8076 - RNA, 23 nt, artificial
  Completely synthesized
uuugcaauaauuucuuuuuagcc

SEQ ID NO: 8077 - RNA, 23 nt, artificial
  Completely synthesized
cuaugaauauaacaaaugacaua

SEQ ID NO: 8078 - RNA, 23 nt, artificial
  Completely synthesized
uaugaauauaacaaaugacauaa

SEQ ID NO: 8079 - RNA, 23 nt, artificial
  Completely synthesized
augaauauaacaaaugacauaag

SEQ ID NO: 8080 - RNA, 23 nt, artificial
  Completely synthesized
aguaaaaaugauaauugucaacu

SEQ ID NO: 8081 - RNA, 23 nt, artificial
  Completely synthesized
guaaaaaugauaauugucaacuu

SEQ ID NO: 8082 - RNA, 23 nt, artificial
  Completely synthesized
uaaaaaugauaauugucaacuuc

SEQ ID NO: 8083 - RNA, 23 nt, artificial
  Completely synthesized
cauaauaauccuuuauuaguacc

SEQ ID NO: 8084 - RNA, 23 nt, artificial
  Completely synthesized
acauaagaacaguauaaauaagu

SEQ ID NO: 8085 - RNA, 23 nt, artificial
  Completely synthesized
cauaagaacaguauaaauaaguu

SEQ ID NO: 8086 - RNA, 23 nt, artificial
  Completely synthesized
auaagaacaguauaaauaaguuu

SEQ ID NO: 8087 - RNA, 23 nt, artificial
  Completely synthesized
uaagaacaguauaaauaaguuuu

SEQ ID NO: 8088 - RNA, 23 nt, artificial
  Completely synthesized
aagaacaguauaaauaaguuuuu

SEQ ID NO: 8089 - RNA, 23 nt, artificial
  Completely synthesized
aagcauuaagaaaauguggacua

SEQ ID NO: 8090 - RNA, 23 nt, artificial
  Completely synthesized
cagaugucauaucaucauauaaa

SEQ ID NO: 8091 - RNA, 23 nt, artificial
  Completely synthesized
agaugucauaucaucauauaaau

SEQ ID NO: 8092 - RNA, 23 nt, artificial
  Completely synthesized
gaugucauaucaucauauaaauc

SEQ ID NO: 8093 - RNA, 23 nt, artificial
  Completely synthesized
augucauaucaucauauaaaucu

SEQ ID NO: 8094 - RNA, 23 nt, artificial
  Completely synthesized
ugucauaucaucauauaaaucua

SEQ ID NO: 8095 - RNA, 23 nt, artificial
  Completely synthesized
gucauaucaucauauaaaucuau

SEQ ID NO: 8096 - RNA, 23 nt, artificial
  Completely synthesized
aaguuucguauuauuuucuauac

SEQ ID NO: 8097 - RNA, 23 nt, artificial
  Completely synthesized
aguuucguauuauuuucuauacu

SEQ ID NO: 8098 - RNA, 23 nt, artificial
  Completely synthesized
guuucguauuauuuucuauacua

SEQ ID NO: 8099 - RNA, 23 nt, artificial
  Completely synthesized
uuucguauuauuuucuauacuag

SEQ ID NO: 8100 - RNA, 23 nt, artificial
  Completely synthesized
uucguauuauuuucuauacuagu

SEQ ID NO: 8101 - RNA, 23 nt, artificial
  Completely synthesized
ugguguccuaagaaauuguuuac

SEQ ID NO: 8102 - RNA, 23 nt, artificial
  Completely synthesized
gguguccuaagaaauuguuuaca

SEQ ID NO: 8103 - RNA, 23 nt, artificial
  Completely synthesized
gagcaauuuuucuuuuucaucuu

SEQ ID NO: 8104 - RNA, 23 nt, artificial
  Completely synthesized
agcaauuuuucuuuuucaucuuu

SEQ ID NO: 8105 - RNA, 23 nt, artificial
  Completely synthesized
auacuaguuuuggcuaugauuuu

SEQ ID NO: 8106 - RNA, 23 nt, artificial
  Completely synthesized
gcuaguuuuuuuguacuauuaua

SEQ ID NO: 8107 - RNA, 23 nt, artificial
  Completely synthesized
aaguaauucuaugcaaaaucaua

SEQ ID NO: 8108 - RNA, 23 nt, artificial
  Completely synthesized
gauuuagaucauuugaaagauga

SEQ ID NO: 8109 - RNA, 23 nt, artificial
  Completely synthesized
guacuaauaaaggauuauuauga

SEQ ID NO: 8110 - RNA, 23 nt, artificial
  Completely synthesized
cuuuaacuguaaacaauuucuua

SEQ ID NO: 8111 - RNA, 23 nt, artificial
  Completely synthesized
guguaaauacuacaaaaacuuau

SEQ ID NO: 8112 - RNA, 23 nt, artificial
  Completely synthesized
auuuauacuguucuuaugucauu

SEQ ID NO: 8113 - RNA, 23 nt, artificial
  Completely synthesized
uacuauuauacuaaaagcuccua

SEQ ID NO: 8114 - RNA, 23 nt, artificial
  Completely synthesized
uauuuauacuguucuuaugucau

SEQ ID NO: 8115 - RNA, 23 nt, artificial
  Completely synthesized
aaaacuaaccacuauguacuuuu

SEQ ID NO: 8116 - RNA, 23 nt, artificial
  Completely synthesized
aaacuaaccacuauguacuuuuu

SEQ ID NO: 8117 - RNA, 23 nt, artificial
  Completely synthesized
caaaaacuuauuuauacuguucu

SEQ ID NO: 8118 - RNA, 23 nt, artificial
  Completely synthesized
auaauacgaaacuuuaaaaagca

SEQ ID NO: 8119 - RNA, 23 nt, artificial
  Completely synthesized
aacuaguauagaaaauaauacga

SEQ ID NO: 8120 - RNA, 23 nt, artificial
  Completely synthesized
agcuaguuuuuuuguacuauuau

SEQ ID NO: 8121 - RNA, 23 nt, artificial
  Completely synthesized
ucuuaugucauuuguuauauuca

SEQ ID NO: 8122 - RNA, 23 nt, artificial
  Completely synthesized
cucauacuuuauaaguaauucua

SEQ ID NO: 8123 - RNA, 23 nt, artificial
  Completely synthesized
uacuuuauaaguaauucuaugca

SEQ ID NO: 8124 - RNA, 23 nt, artificial
  Completely synthesized
cauacuuuauaaguaauucuaug

SEQ ID NO: 8125 - RNA, 23 nt, artificial
  Completely synthesized
uuauuuauacuguucuuauguca

SEQ ID NO: 8126 - RNA, 23 nt, artificial
  Completely synthesized
cuacaaaaacuuauuuauacugu

SEQ ID NO: 8127 - RNA, 23 nt, artificial
  Completely synthesized
acuuuaacuguaaacaauuucuu

SEQ ID NO: 8128 - RNA, 23 nt, artificial
  Completely synthesized
gcucuccauaucccauucccugu

SEQ ID NO: 8129 - RNA, 23 nt, artificial
  Completely synthesized
uuucucccaauucagccagccca

SEQ ID NO: 8130 - RNA, 23 nt, artificial
  Completely synthesized
uggcaauguuuuccuuguuccca

SEQ ID NO: 8131 - RNA, 23 nt, artificial
  Completely synthesized
guccacauuuucuuaaugcuuuu

SEQ ID NO: 8132 - RNA, 23 nt, artificial
  Completely synthesized
cuuauuuauacuguucuuauguc

SEQ ID NO: 8133 - RNA, 23 nt, artificial
  Completely synthesized
acacacgguccacagcucaucau

SEQ ID NO: 8134 - RNA, 23 nt, artificial
  Completely synthesized
caaaucagaugcuuuguacuuug

SEQ ID NO: 8135 - RNA, 23 nt, artificial
  Completely synthesized
uaaaagcuccuacugugauguga

SEQ ID NO: 8136 - RNA, 23 nt, artificial
  Completely synthesized
cuuuuuuauaaauacuguaugga

SEQ ID NO: 8137 - RNA, 23 nt, artificial
  Completely synthesized
uauaauaguacaaaaaaacuagc

SEQ ID NO: 8138 - RNA, 23 nt, artificial
  Completely synthesized
uaugauuuugcauagaauuacuu

SEQ ID NO: 8139 - RNA, 23 nt, artificial
  Completely synthesized
ucaucuuucaaaugaucuaaauc

SEQ ID NO: 8140 - RNA, 23 nt, artificial
  Completely synthesized
ucauaauaauccuuuauuaguac

SEQ ID NO: 8141 - RNA, 23 nt, artificial
  Completely synthesized
uaagaaauuguuuacaguuaaag

SEQ ID NO: 8142 - RNA, 23 nt, artificial
  Completely synthesized
auaaguuuuuguaguauuuacac

SEQ ID NO: 8143 - RNA, 23 nt, artificial
  Completely synthesized
aaugacauaagaacaguauaaau

SEQ ID NO: 8144 - RNA, 23 nt, artificial
  Completely synthesized
uaggagcuuuuaguauaauagua

SEQ ID NO: 8145 - RNA, 23 nt, artificial
  Completely synthesized
augacauaagaacaguauaaaua

SEQ ID NO: 8146 - RNA, 23 nt, artificial
  Completely synthesized
aaaaguacauagugguuaguuuu

SEQ ID NO: 8147 - RNA, 23 nt, artificial
  Completely synthesized
aaaaaguacauagugguuaguuu

SEQ ID NO: 8148 - RNA, 23 nt, artificial
  Completely synthesized
agaacaguauaaauaaguuuuug

SEQ ID NO: 8149 - RNA, 23 nt, artificial
  Completely synthesized
ugcuuuuuaaaguuucguauuau

SEQ ID NO: 8150 - RNA, 23 nt, artificial
  Completely synthesized
ucguauuauuuucuauacuaguu

SEQ ID NO: 8151 - RNA, 23 nt, artificial
  Completely synthesized
auaauaguacaaaaaaacuagcu

SEQ ID NO: 8152 - RNA, 23 nt, artificial
  Completely synthesized
ugaauauaacaaaugacauaaga

SEQ ID NO: 8153 - RNA, 23 nt, artificial
  Completely synthesized
uagaauuacuuauaaaguaugag

SEQ ID NO: 8154 - RNA, 23 nt, artificial
  Completely synthesized
ugcauagaauuacuuauaaagua

SEQ ID NO: 8155 - RNA, 23 nt, artificial
  Completely synthesized
cauagaauuacuuauaaaguaug

SEQ ID NO: 8156 - RNA, 23 nt, artificial
  Completely synthesized
ugacauaagaacaguauaaauaa

SEQ ID NO: 8157 - RNA, 23 nt, artificial
  Completely synthesized
acaguauaaauaaguuuuuguag

SEQ ID NO: 8158 - RNA, 23 nt, artificial
  Completely synthesized
aagaaauuguuuacaguuaaagu

SEQ ID NO: 8159 - RNA, 23 nt, artificial
  Completely synthesized
acagggaaugggauauggagagc

SEQ ID NO: 8160 - RNA, 23 nt, artificial
  Completely synthesized
ugggcuggcugaauugggagaaa

SEQ ID NO: 8161 - RNA, 23 nt, artificial
  Completely synthesized
ugggaacaaggaaaacauugcca

SEQ ID NO: 8162 - RNA, 23 nt, artificial
  Completely synthesized
aaaagcauuaagaaaauguggac

SEQ ID NO: 8163 - RNA, 23 nt, artificial
  Completely synthesized
gacauaagaacaguauaaauaag

SEQ ID NO: 8164 - RNA, 23 nt, artificial
  Completely synthesized
augaugagcuguggaccgugugu

SEQ ID NO: 8165 - RNA, 23 nt, artificial
  Completely synthesized
caaaguacaaagcaucugauuug

SEQ ID NO: 8166 - RNA, 23 nt, artificial
  Completely synthesized
ucacaucacaguaggagcuuuua

SEQ ID NO: 8167 - RNA, 23 nt, artificial
  Completely synthesized
uccauacaguauuuauaaaaaag

SEQ ID NO: 8168 - RNA, 19 nt, artificial
  Completely synthesized
uagggcaaaagcucuccau

SEQ ID NO: 8169 - RNA, 19 nt, artificial
  Completely synthesized
cccagcaggacauggauuu

SEQ ID NO: 8170 - RNA, 19 nt, artificial
  Completely synthesized
cagcgaccuucgcaaacaa

SEQ ID NO: 8171 - RNA, 19 nt, artificial
  Completely synthesized
cuguuuaaacuguuucaaa

SEQ ID NO: 8172 - RNA, 19 nt, artificial
  Completely synthesized
guuuguuccaacuguuuaa

SEQ ID NO: 8173 - RNA, 19 nt, artificial
  Completely synthesized
gggauuuucggaagcucag

SEQ ID NO: 8174 - RNA, 19 nt, artificial
  Completely synthesized
cuucgcaaacaacucuuua

SEQ ID NO: 8175 - RNA, 19 nt, artificial
  Completely synthesized
cgcaaacaacucuuuaucu

SEQ ID NO: 8176 - RNA, 19 nt, artificial
  Completely synthesized
ccaacuguuuaaacuguuu

SEQ ID NO: 8177 - RNA, 19 nt, artificial
  Completely synthesized
aacuguuuaaacuguuuca

SEQ ID NO: 8178 - RNA, 19 nt, artificial
  Completely synthesized
uucccuguagaaaaaauca

SEQ ID NO: 8179 - RNA, 19 nt, artificial
  Completely synthesized
gagagcgcugcccuuauuu

SEQ ID NO: 8180 - RNA, 19 nt, artificial
  Completely synthesized
cuguuucaaagcguccgaa

SEQ ID NO: 8181 - RNA, 19 nt, artificial
  Completely synthesized
acuguuuaaacuguuucaa

SEQ ID NO: 8182 - RNA, 19 nt, artificial
  Completely synthesized
uaccaugguuccaagucca

SEQ ID NO: 8183 - RNA, 19 nt, artificial
  Completely synthesized
cgaccuucgcaaacaacuc

SEQ ID NO: 8184 - RNA, 19 nt, artificial
  Completely synthesized
aaaggauuauuaugacugu

SEQ ID NO: 8185 - RNA, 19 nt, artificial
  Completely synthesized
ccagucagaaaccagugga

SEQ ID NO: 8186 - RNA, 19 nt, artificial
  Completely synthesized
cuaacggagaccuccucua

SEQ ID NO: 8187 - RNA, 19 nt, artificial
  Completely synthesized
aagcuuucaaccaaaacca

SEQ ID NO: 8188 - RNA, 19 nt, artificial
  Completely synthesized
gcgaccuucgcaaacaacu

SEQ ID NO: 8189 - RNA, 19 nt, artificial
  Completely synthesized
agugaacucauuaaauuca

SEQ ID NO: 8190 - RNA, 19 nt, artificial
  Completely synthesized
agcuaguuuuuuuguacua

SEQ ID NO: 8191 - RNA, 19 nt, artificial
  Completely synthesized
ccagauguuaagaaaaacu

SEQ ID NO: 8192 - RNA, 19 nt, artificial
  Completely synthesized
ugggaggagcuauuaucca

SEQ ID NO: 8193 - RNA, 19 nt, artificial
  Completely synthesized
guggaaucuuccagcuaug

SEQ ID NO: 8194 - RNA, 19 nt, artificial
  Completely synthesized
cuaguauagaaaauaauac

SEQ ID NO: 8195 - RNA, 19 nt, artificial
  Completely synthesized
cagugaacucauuaaauuc

SEQ ID NO: 8196 - RNA, 19 nt, artificial
  Completely synthesized
uaacuguaguccacauuuu

SEQ ID NO: 8197 - RNA, 19 nt, artificial
  Completely synthesized
uucgcaaacaacucuuuau

SEQ ID NO: 8198 - RNA, 19 nt, artificial
  Completely synthesized
uacguuucagucacuuguu

SEQ ID NO: 8199 - RNA, 19 nt, artificial
  Completely synthesized
uggaaaaccuuauucuccu

SEQ ID NO: 8200 - RNA, 19 nt, artificial
  Completely synthesized
aagccuuuuucgcucaguu

SEQ ID NO: 8201 - RNA, 19 nt, artificial
  Completely synthesized
cuacugaaaaaacaacuca

SEQ ID NO: 8202 - RNA, 19 nt, artificial
  Completely synthesized
ucaaagcguccgaacucca

SEQ ID NO: 8203 - RNA, 19 nt, artificial
  Completely synthesized
caccagaacacucagugga

SEQ ID NO: 8204 - RNA, 19 nt, artificial
  Completely synthesized
cuuugaugacugcaugcag

SEQ ID NO: 8205 - RNA, 19 nt, artificial
  Completely synthesized
aggauuauuaugacuguua

SEQ ID NO: 8206 - RNA, 19 nt, artificial
  Completely synthesized
aucauuugaaagaugaaaa

SEQ ID NO: 8207 - RNA, 19 nt, artificial
  Completely synthesized
gaugcccaaugugagaaca

SEQ ID NO: 8208 - RNA, 19 nt, artificial
  Completely synthesized
agagcaguucaaugaagcu

SEQ ID NO: 8209 - RNA, 19 nt, artificial
  Completely synthesized
gauggaaaaccuuauucuc

SEQ ID NO: 8210 - RNA, 19 nt, artificial
  Completely synthesized
guguaaauacuacaaaaac

SEQ ID NO: 8211 - RNA, 19 nt, artificial
  Completely synthesized
ucagucacuuguuccugau

SEQ ID NO: 8212 - RNA, 19 nt, artificial
  Completely synthesized
uaguuucacuuuaacugua

SEQ ID NO: 8213 - RNA, 19 nt, artificial
  Completely synthesized
uccacauuuucuuaaugcu

SEQ ID NO: 8214 - RNA, 19 nt, artificial
  Completely synthesized
agucgagaaguauuugacu

SEQ ID NO: 8215 - RNA, 19 nt, artificial
  Completely synthesized
cagucaccugaaacuucug

SEQ ID NO: 8216 - RNA, 19 nt, artificial
  Completely synthesized
aguauagaaaauaauacga

SEQ ID NO: 8217 - RNA, 19 nt, artificial
  Completely synthesized
ugguccuaaaacaccagua

SEQ ID NO: 8218 - RNA, 19 nt, artificial
  Completely synthesized
aagcugguugagacuacca

SEQ ID NO: 8219 - RNA, 19 nt, artificial
  Completely synthesized
cuccggcauuucacuaaac

SEQ ID NO: 8220 - RNA, 19 nt, artificial
  Completely synthesized
uuccuuguucccaaaagua

SEQ ID NO: 8221 - RNA, 19 nt, artificial
  Completely synthesized
ugaauacucccugcagcaa

SEQ ID NO: 8222 - RNA, 19 nt, artificial
  Completely synthesized
ucagucagcgacggaaaga

SEQ ID NO: 8223 - RNA, 19 nt, artificial
  Completely synthesized
uguuuguuccaacuguuua

SEQ ID NO: 8224 - RNA, 19 nt, artificial
  Completely synthesized
ccuucgcaaacaacucuuu

SEQ ID NO: 8225 - RNA, 19 nt, artificial
  Completely synthesized
uacucccugcagcaaacaa

SEQ ID NO: 8226 - RNA, 19 nt, artificial
  Completely synthesized
uggugaugaauuuuauucu

SEQ ID NO: 8227 - RNA, 19 nt, artificial
  Completely synthesized
caagaacaacuccaaaagg

SEQ ID NO: 8228 - RNA, 19 nt, artificial
  Completely synthesized
cccaaaucagaugcuuugu

SEQ ID NO: 8229 - RNA, 19 nt, artificial
  Completely synthesized
guuucaaagcguccgaacu

SEQ ID NO: 8230 - RNA, 19 nt, artificial
  Completely synthesized
aauaaaggauuauuaugac

SEQ ID NO: 8231 - RNA, 19 nt, artificial
  Completely synthesized
uguuuaaacuguuucaaag

SEQ ID NO: 8232 - RNA, 19 nt, artificial
  Completely synthesized
aguucaaugaagcucaacu

SEQ ID NO: 8233 - RNA, 19 nt, artificial
  Completely synthesized
gcagacauucccguuugua

SEQ ID NO: 8234 - RNA, 19 nt, artificial
  Completely synthesized
cugaaagcacagcagaauu

SEQ ID NO: 8235 - RNA, 19 nt, artificial
  Completely synthesized
cugacagaaguugacaauu

SEQ ID NO: 8236 - RNA, 19 nt, artificial
  Completely synthesized
auguuaagaaaaacuagau

SEQ ID NO: 8237 - RNA, 19 nt, artificial
  Completely synthesized
uaauucuaugcaaaaucau

SEQ ID NO: 8238 - RNA, 19 nt, artificial
  Completely synthesized
gguccuaaaacaccaguac

SEQ ID NO: 8239 - RNA, 19 nt, artificial
  Completely synthesized
uguuccaacuguuuaaacu

SEQ ID NO: 8240 - RNA, 19 nt, artificial
  Completely synthesized
guguuuguuccaacuguuu

SEQ ID NO: 8241 - RNA, 19 nt, artificial
  Completely synthesized
acugacagaaguugacaau

SEQ ID NO: 8242 - RNA, 19 nt, artificial
  Completely synthesized
ggagcuauuauccauuccu

SEQ ID NO: 8243 - RNA, 19 nt, artificial
  Completely synthesized
ggauuuucggaagcucagc

SEQ ID NO: 8244 - RNA, 19 nt, artificial
  Completely synthesized
gagcccagucuucauugcu

SEQ ID NO: 8245 - RNA, 19 nt, artificial
  Completely synthesized
acuguuucaaagcguccga

SEQ ID NO: 8246 - RNA, 19 nt, artificial
  Completely synthesized
caaagcuuucaaccaaaac

SEQ ID NO: 8247 - RNA, 19 nt, artificial
  Completely synthesized
cuaauaaaggauuauuaug

SEQ ID NO: 8248 - RNA, 19 nt, artificial
  Completely synthesized
uuggaggcucaucucacaa

SEQ ID NO: 8249 - RNA, 19 nt, artificial
  Completely synthesized
guugacaauuaucauuuuu

SEQ ID NO: 8250 - RNA, 19 nt, artificial
  Completely synthesized
ucauagauuuauaugauga

SEQ ID NO: 8251 - RNA, 19 nt, artificial
  Completely synthesized
agcagaauucaaugauucu

SEQ ID NO: 8252 - RNA, 19 nt, artificial
  Completely synthesized
gucagaaaccaguggaucu

SEQ ID NO: 8253 - RNA, 19 nt, artificial
  Completely synthesized
auucccggucacaucgaga

SEQ ID NO: 8254 - RNA, 19 nt, artificial
  Completely synthesized
uaugcaacaggacauugag

SEQ ID NO: 8255 - RNA, 19 nt, artificial
  Completely synthesized
uucagucacuuguuccuga

SEQ ID NO: 8256 - RNA, 19 nt, artificial
  Completely synthesized
gacaagcugguugagacua

SEQ ID NO: 8257 - RNA, 19 nt, artificial
  Completely synthesized
uugacuucaacgaaaugau

SEQ ID NO: 8258 - RNA, 19 nt, artificial
  Completely synthesized
gaggauuugaccuuuucug

SEQ ID NO: 8259 - RNA, 19 nt, artificial
  Completely synthesized
uuuccuuguucccaaaagu

SEQ ID NO: 8260 - RNA, 19 nt, artificial
  Completely synthesized
caagcugguugagacuacc

SEQ ID NO: 8261 - RNA, 19 nt, artificial
  Completely synthesized
aacuccaaaaggagcaaga

SEQ ID NO: 8262 - RNA, 19 nt, artificial
  Completely synthesized
aaucuuccagcuauggaga

SEQ ID NO: 8263 - RNA, 19 nt, artificial
  Completely synthesized
aggaggauuugaccuuuuc

SEQ ID NO: 8264 - RNA, 19 nt, artificial
  Completely synthesized
aaguauuugacuucaguca

SEQ ID NO: 8265 - RNA, 19 nt, artificial
  Completely synthesized
guuuuccuuguucccaaaa

SEQ ID NO: 8266 - RNA, 19 nt, artificial
  Completely synthesized
uucuaaaugggcccauuga

SEQ ID NO: 8267 - RNA, 19 nt, artificial
  Completely synthesized
caguaucagcaacagcaug

SEQ ID NO: 8268 - RNA, 19 nt, artificial
  Completely synthesized
aaggauuauuaugacuguu

SEQ ID NO: 8269 - RNA, 19 nt, artificial
  Completely synthesized
caacccuugucaccaucuc

SEQ ID NO: 8270 - RNA, 19 nt, artificial
  Completely synthesized
gaacacucaguggaaucuu

SEQ ID NO: 8271 - RNA, 19 nt, artificial
  Completely synthesized
ugcccucaccugcuacuuu

SEQ ID NO: 8272 - RNA, 19 nt, artificial
  Completely synthesized
uccugauauucccggucac

SEQ ID NO: 8273 - RNA, 19 nt, artificial
  Completely synthesized
uuuguuccaacuguuuaaa

SEQ ID NO: 8274 - RNA, 19 nt, artificial
  Completely synthesized
gacaaaagccuucaccuac

SEQ ID NO: 8275 - RNA, 19 nt, artificial
  Completely synthesized
gaggcucaucucacaagag

SEQ ID NO: 8276 - RNA, 19 nt, artificial
  Completely synthesized
uuucuucggcuacguuuca

SEQ ID NO: 8277 - RNA, 19 nt, artificial
  Completely synthesized
ggcaaaagcucuccauauc

SEQ ID NO: 8278 - RNA, 19 nt, artificial
  Completely synthesized
cugcucagaauugcagaaa

SEQ ID NO: 8279 - RNA, 19 nt, artificial
  Completely synthesized
ucagucaccugaaacuucu

SEQ ID NO: 8280 - RNA, 19 nt, artificial
  Completely synthesized
ggugaauuucucccaauuc

SEQ ID NO: 8281 - RNA, 19 nt, artificial
  Completely synthesized
gaacuuagggcaaaagcuc

SEQ ID NO: 8282 - RNA, 19 nt, artificial
  Completely synthesized
uuucgcucaguuacaacua

SEQ ID NO: 8283 - RNA, 19 nt, artificial
  Completely synthesized
acagaaguugacaauuauc

SEQ ID NO: 8284 - RNA, 19 nt, artificial
  Completely synthesized
aacuuagggcaaaagcucu

SEQ ID NO: 8285 - RNA, 19 nt, artificial
  Completely synthesized
uccaacuguuuaaacuguu

SEQ ID NO: 8286 - RNA, 19 nt, artificial
  Completely synthesized
caccauuugggcuaguuuc

SEQ ID NO: 8287 - RNA, 19 nt, artificial
  Completely synthesized
gccucagugauucugaagu

SEQ ID NO: 8288 - RNA, 19 nt, artificial
  Completely synthesized
cuuauucuccuagugaaua

SEQ ID NO: 8289 - RNA, 19 nt, artificial
  Completely synthesized
ggccucagugauucugaag

SEQ ID NO: 8290 - RNA, 19 nt, artificial
  Completely synthesized
aaaugacaagcugguugag

SEQ ID NO: 8291 - RNA, 19 nt, artificial
  Completely synthesized
uaaguccuggucaucggaa

SEQ ID NO: 8292 - RNA, 19 nt, artificial
  Completely synthesized
gcaaacaacucuuuaucuc

SEQ ID NO: 8293 - RNA, 19 nt, artificial
  Completely synthesized
caaaagccuucaccuacug

SEQ ID NO: 8294 - RNA, 19 nt, artificial
  Completely synthesized
aaacugacagaaguugaca

SEQ ID NO: 8295 - RNA, 19 nt, artificial
  Completely synthesized
gaccuucgcaaacaacucu

SEQ ID NO: 8296 - RNA, 19 nt, artificial
  Completely synthesized
aaugacaagcugguugaga

SEQ ID NO: 8297 - RNA, 19 nt, artificial
  Completely synthesized
caaacaacucuuuaucucg

SEQ ID NO: 8298 - RNA, 19 nt, artificial
  Completely synthesized
uuugaggauuccuucagca

SEQ ID NO: 8299 - RNA, 19 nt, artificial
  Completely synthesized
gagcaagagaaagccuuuu

SEQ ID NO: 8300 - RNA, 19 nt, artificial
  Completely synthesized
gacuaccaugguuccaagu

SEQ ID NO: 8301 - RNA, 19 nt, artificial
  Completely synthesized
agcccaguaucagcaacag

SEQ ID NO: 8302 - RNA, 19 nt, artificial
  Completely synthesized
ugguugagacuaccauggu

SEQ ID NO: 8303 - RNA, 19 nt, artificial
  Completely synthesized
gcaagagaaagccuuuuuc

SEQ ID NO: 8304 - RNA, 19 nt, artificial
  Completely synthesized
agagcgcugcccuuauuug

SEQ ID NO: 8305 - RNA, 19 nt, artificial
  Completely synthesized
gcucaguuacaacuagaug

SEQ ID NO: 8306 - RNA, 19 nt, artificial
  Completely synthesized
gcucagucaccugaaacuu

SEQ ID NO: 8307 - RNA, 19 nt, artificial
  Completely synthesized
uguuaagaaaaacuagauu

SEQ ID NO: 8308 - RNA, 19 nt, artificial
  Completely synthesized
agaauucaaugauucugac

SEQ ID NO: 8309 - RNA, 19 nt, artificial
  Completely synthesized
aagaaaaacuagauuuagg

SEQ ID NO: 8310 - RNA, 19 nt, artificial
  Completely synthesized
uaacuguaaacaauuucuu

SEQ ID NO: 8311 - RNA, 19 nt, artificial
  Completely synthesized
cauccucuccacagaagac

SEQ ID NO: 8312 - RNA, 19 nt, artificial
  Completely synthesized
auucugcuuucauagcuga

SEQ ID NO: 8313 - RNA, 19 nt, artificial
  Completely synthesized
uaguauagaaaauaauacg

SEQ ID NO: 8314 - RNA, 19 nt, artificial
  Completely synthesized
gauuuaggaggauuugacc

SEQ ID NO: 8315 - RNA, 19 nt, artificial
  Completely synthesized
ugccuguaaguccugguca

SEQ ID NO: 8316 - RNA, 19 nt, artificial
  Completely synthesized
cucccuguuguugacuuca

SEQ ID NO: 8317 - RNA, 19 nt, artificial
  Completely synthesized
aacauucaagccgcuugga

SEQ ID NO: 8318 - RNA, 19 nt, artificial
  Completely synthesized
uagguaacuguaguccaca

SEQ ID NO: 8319 - RNA, 19 nt, artificial
  Completely synthesized
caagagaaagccuuuuucg

SEQ ID NO: 8320 - RNA, 19 nt, artificial
  Completely synthesized
auuggagugucaguauguu

SEQ ID NO: 8321 - RNA, 19 nt, artificial
  Completely synthesized
gaugacugcaugcagcuuu

SEQ ID NO: 8322 - RNA, 19 nt, artificial
  Completely synthesized
uucagucagcgacggaaag

SEQ ID NO: 8323 - RNA, 19 nt, artificial
  Completely synthesized
ucacuuugcaaagcuuuca

SEQ ID NO: 8324 - RNA, 19 nt, artificial
  Completely synthesized
uucggcuacguuucaguca

SEQ ID NO: 8325 - RNA, 19 nt, artificial
  Completely synthesized
uguacuauuauacuaaaag

SEQ ID NO: 8326 - RNA, 19 nt, artificial
  Completely synthesized
ccucagugauucugaagug

SEQ ID NO: 8327 - RNA, 19 nt, artificial
  Completely synthesized
uugaaucaguaguuucacu

SEQ ID NO: 8328 - RNA, 19 nt, artificial
  Completely synthesized
ucagugauucugaagugga

SEQ ID NO: 8329 - RNA, 19 nt, artificial
  Completely synthesized
auggagagcuuuugcccua

SEQ ID NO: 8330 - RNA, 19 nt, artificial
  Completely synthesized
aaauccauguccugcuggg

SEQ ID NO: 8331 - RNA, 19 nt, artificial
  Completely synthesized
uuguuugcgaaggucgcug

SEQ ID NO: 8332 - RNA, 19 nt, artificial
  Completely synthesized
uuugaaacaguuuaaacag

SEQ ID NO: 8333 - RNA, 19 nt, artificial
  Completely synthesized
uuaaacaguuggaacaaac

SEQ ID NO: 8334 - RNA, 19 nt, artificial
  Completely synthesized
cugagcuuccgaaaauccc

SEQ ID NO: 8335 - RNA, 19 nt, artificial
  Completely synthesized
uaaagaguuguuugcgaag

SEQ ID NO: 8336 - RNA, 19 nt, artificial
  Completely synthesized
agauaaagaguuguuugcg

SEQ ID NO: 8337 - RNA, 19 nt, artificial
  Completely synthesized
aaacaguuuaaacaguugg

SEQ ID NO: 8338 - RNA, 19 nt, artificial
  Completely synthesized
ugaaacaguuuaaacaguu

SEQ ID NO: 8339 - RNA, 19 nt, artificial
  Completely synthesized
ugauuuuuucuacagggaa

SEQ ID NO: 8340 - RNA, 19 nt, artificial
  Completely synthesized
aaauaagggcagcgcucuc

SEQ ID NO: 8341 - RNA, 19 nt, artificial
  Completely synthesized
uucggacgcuuugaaacag

SEQ ID NO: 8342 - RNA, 19 nt, artificial
  Completely synthesized
uugaaacaguuuaaacagu

SEQ ID NO: 8343 - RNA, 19 nt, artificial
  Completely synthesized
uggacuuggaaccauggua

SEQ ID NO: 8344 - RNA, 19 nt, artificial
  Completely synthesized
gaguuguuugcgaaggucg

SEQ ID NO: 8345 - RNA, 19 nt, artificial
  Completely synthesized
acagucauaauaauccuuu

SEQ ID NO: 8346 - RNA, 19 nt, artificial
  Completely synthesized
uccacugguuucugacugg

SEQ ID NO: 8347 - RNA, 19 nt, artificial
  Completely synthesized
uagaggaggucuccguuag

SEQ ID NO: 8348 - RNA, 19 nt, artificial
  Completely synthesized
ugguuuugguugaaagcuu

SEQ ID NO: 8349 - RNA, 19 nt, artificial
  Completely synthesized
aguuguuugcgaaggucgc

SEQ ID NO: 8350 - RNA, 19 nt, artificial
  Completely synthesized
ugaauuuaaugaguucacu

SEQ ID NO: 8351 - RNA, 19 nt, artificial
  Completely synthesized
uaguacaaaaaaacuagcu

SEQ ID NO: 8352 - RNA, 19 nt, artificial
  Completely synthesized
aguuuuucuuaacaucugg

SEQ ID NO: 8353 - RNA, 19 nt, artificial
  Completely synthesized
uggauaauagcuccuccca

SEQ ID NO: 8354 - RNA, 19 nt, artificial
  Completely synthesized
cauagcuggaagauuccac

SEQ ID NO: 8355 - RNA, 19 nt, artificial
  Completely synthesized
guauuauuuucuauacuag

SEQ ID NO: 8356 - RNA, 19 nt, artificial
  Completely synthesized
gaauuuaaugaguucacug

SEQ ID NO: 8357 - RNA, 19 nt, artificial
  Completely synthesized
aaaauguggacuacaguua

SEQ ID NO: 8358 - RNA, 19 nt, artificial
  Completely synthesized
auaaagaguuguuugcgaa

SEQ ID NO: 8359 - RNA, 19 nt, artificial
  Completely synthesized
aacaagugacugaaacgua

SEQ ID NO: 8360 - RNA, 19 nt, artificial
  Completely synthesized
aggagaauaagguuuucca

SEQ ID NO: 8361 - RNA, 19 nt, artificial
  Completely synthesized
aacugagcgaaaaaggcuu

SEQ ID NO: 8362 - RNA, 19 nt, artificial
  Completely synthesized
ugaguuguuuuuucaguag

SEQ ID NO: 8363 - RNA, 19 nt, artificial
  Completely synthesized
uggaguucggacgcuuuga

SEQ ID NO: 8364 - RNA, 19 nt, artificial
  Completely synthesized
uccacugaguguucuggug

SEQ ID NO: 8365 - RNA, 19 nt, artificial
  Completely synthesized
cugcaugcagucaucaaag

SEQ ID NO: 8366 - RNA, 19 nt, artificial
  Completely synthesized
uaacagucauaauaauccu

SEQ ID NO: 8367 - RNA, 19 nt, artificial
  Completely synthesized
uuuucaucuuucaaaugau

SEQ ID NO: 8368 - RNA, 19 nt, artificial
  Completely synthesized
uguucucacauugggcauc

SEQ ID NO: 8369 - RNA, 19 nt, artificial
  Completely synthesized
agcuucauugaacugcucu

SEQ ID NO: 8370 - RNA, 19 nt, artificial
  Completely synthesized
gagaauaagguuuuccauc

SEQ ID NO: 8371 - RNA, 19 nt, artificial
  Completely synthesized
guuuuuguaguauuuacac

SEQ ID NO: 8372 - RNA, 19 nt, artificial
  Completely synthesized
aucaggaacaagugacuga

SEQ ID NO: 8373 - RNA, 19 nt, artificial
  Completely synthesized
uacaguuaaagugaaacua

SEQ ID NO: 8374 - RNA, 19 nt, artificial
  Completely synthesized
agcauuaagaaaaugugga

SEQ ID NO: 8375 - RNA, 19 nt, artificial
  Completely synthesized
agucaaauacuucucgacu

SEQ ID NO: 8376 - RNA, 19 nt, artificial
  Completely synthesized
cagaaguuucaggugacug

SEQ ID NO: 8377 - RNA, 19 nt, artificial
  Completely synthesized
ucguauuauuuucuauacu

SEQ ID NO: 8378 - RNA, 19 nt, artificial
  Completely synthesized
uacugguguuuuaggacca

SEQ ID NO: 8379 - RNA, 19 nt, artificial
  Completely synthesized
ugguagucucaaccagcuu

SEQ ID NO: 8380 - RNA, 19 nt, artificial
  Completely synthesized
guuuagugaaaugccggag

SEQ ID NO: 8381 - RNA, 19 nt, artificial
  Completely synthesized
uacuuuugggaacaaggaa

SEQ ID NO: 8382 - RNA, 19 nt, artificial
  Completely synthesized
uugcugcagggaguauuca

SEQ ID NO: 8383 - RNA, 19 nt, artificial
  Completely synthesized
ucuuuccgucgcugacuga

SEQ ID NO: 8384 - RNA, 19 nt, artificial
  Completely synthesized
uaaacaguuggaacaaaca

SEQ ID NO: 8385 - RNA, 19 nt, artificial
  Completely synthesized
aaagaguuguuugcgaagg

SEQ ID NO: 8386 - RNA, 19 nt, artificial
  Completely synthesized
uuguuugcugcagggagua

SEQ ID NO: 8387 - RNA, 19 nt, artificial
  Completely synthesized
agaauaaaauucaucacca

SEQ ID NO: 8388 - RNA, 19 nt, artificial
  Completely synthesized
ccuuuuggaguuguucuug

SEQ ID NO: 8389 - RNA, 19 nt, artificial
  Completely synthesized
acaaagcaucugauuuggg

SEQ ID NO: 8390 - RNA, 19 nt, artificial
  Completely synthesized
aguucggacgcuuugaaac

SEQ ID NO: 8391 - RNA, 19 nt, artificial
  Completely synthesized
gucauaauaauccuuuauu

SEQ ID NO: 8392 - RNA, 19 nt, artificial
  Completely synthesized
cuuugaaacaguuuaaaca

SEQ ID NO: 8393 - RNA, 19 nt, artificial
  Completely synthesized
aguugagcuucauugaacu

SEQ ID NO: 8394 - RNA, 19 nt, artificial
  Completely synthesized
uacaaacgggaaugucugc

SEQ ID NO: 8395 - RNA, 19 nt, artificial
  Completely synthesized
aauucugcugugcuuucag

SEQ ID NO: 8396 - RNA, 19 nt, artificial
  Completely synthesized
aauugucaacuucugucag

SEQ ID NO: 8397 - RNA, 19 nt, artificial
  Completely synthesized
aucuaguuuuucuuaacau

SEQ ID NO: 8398 - RNA, 19 nt, artificial
  Completely synthesized
augauuuugcauagaauua

SEQ ID NO: 8399 - RNA, 19 nt, artificial
  Completely synthesized
guacugguguuuuaggacc

SEQ ID NO: 8400 - RNA, 19 nt, artificial
  Completely synthesized
aguuuaaacaguuggaaca

SEQ ID NO: 8401 - RNA, 19 nt, artificial
  Completely synthesized
aaacaguuggaacaaacac

SEQ ID NO: 8402 - RNA, 19 nt, artificial
  Completely synthesized
auugucaacuucugucagu

SEQ ID NO: 8403 - RNA, 19 nt, artificial
  Completely synthesized
aggaauggauaauagcucc

SEQ ID NO: 8404 - RNA, 19 nt, artificial
  Completely synthesized
gcugagcuuccgaaaaucc

SEQ ID NO: 8405 - RNA, 19 nt, artificial
  Completely synthesized
agcaaugaagacugggcuc

SEQ ID NO: 8406 - RNA, 19 nt, artificial
  Completely synthesized
ucggacgcuuugaaacagu

SEQ ID NO: 8407 - RNA, 19 nt, artificial
  Completely synthesized
guuuugguugaaagcuuug

SEQ ID NO: 8408 - RNA, 19 nt, artificial
  Completely synthesized
cauaauaauccuuuauuag

SEQ ID NO: 8409 - RNA, 19 nt, artificial
  Completely synthesized
uugugagaugagccuccaa

SEQ ID NO: 8410 - RNA, 19 nt, artificial
  Completely synthesized
aaaaaugauaauugucaac

SEQ ID NO: 8411 - RNA, 19 nt, artificial
  Completely synthesized
ucaucauauaaaucuauga

SEQ ID NO: 8412 - RNA, 19 nt, artificial
  Completely synthesized
agaaucauugaauucugcu

SEQ ID NO: 8413 - RNA, 19 nt, artificial
  Completely synthesized
agauccacugguuucugac

SEQ ID NO: 8414 - RNA, 19 nt, artificial
  Completely synthesized
ucucgaugugaccgggaau

SEQ ID NO: 8415 - RNA, 19 nt, artificial
  Completely synthesized
cucaauguccuguugcaua

SEQ ID NO: 8416 - RNA, 19 nt, artificial
  Completely synthesized
ucaggaacaagugacugaa

SEQ ID NO: 8417 - RNA, 19 nt, artificial
  Completely synthesized
uagucucaaccagcuuguc

SEQ ID NO: 8418 - RNA, 19 nt, artificial
  Completely synthesized
aucauuucguugaagucaa

SEQ ID NO: 8419 - RNA, 19 nt, artificial
  Completely synthesized
cagaaaaggucaaauccuc

SEQ ID NO: 8420 - RNA, 19 nt, artificial
  Completely synthesized
acuuuugggaacaaggaaa

SEQ ID NO: 8421 - RNA, 19 nt, artificial
  Completely synthesized
gguagucucaaccagcuug

SEQ ID NO: 8422 - RNA, 19 nt, artificial
  Completely synthesized
ucuugcuccuuuuggaguu

SEQ ID NO: 8423 - RNA, 19 nt, artificial
  Completely synthesized
ucuccauagcuggaagauu

SEQ ID NO: 8424 - RNA, 19 nt, artificial
  Completely synthesized
gaaaaggucaaauccuccu

SEQ ID NO: 8425 - RNA, 19 nt, artificial
  Completely synthesized
ugacugaagucaaauacuu

SEQ ID NO: 8426 - RNA, 19 nt, artificial
  Completely synthesized
uuuugggaacaaggaaaac

SEQ ID NO: 8427 - RNA, 19 nt, artificial
  Completely synthesized
ucaaugggcccauuuagaa

SEQ ID NO: 8428 - RNA, 19 nt, artificial
  Completely synthesized
caugcuguugcugauacug

SEQ ID NO: 8429 - RNA, 19 nt, artificial
  Completely synthesized
aacagucauaauaauccuu

SEQ ID NO: 8430 - RNA, 19 nt, artificial
  Completely synthesized
gagauggugacaaggguug

SEQ ID NO: 8431 - RNA, 19 nt, artificial
  Completely synthesized
aagauuccacugaguguuc

SEQ ID NO: 8432 - RNA, 19 nt, artificial
  Completely synthesized
aaaguagcaggugagggca

SEQ ID NO: 8433 - RNA, 19 nt, artificial
  Completely synthesized
gugaccgggaauaucagga

SEQ ID NO: 8434 - RNA, 19 nt, artificial
  Completely synthesized
uuuaaacaguuggaacaaa

SEQ ID NO: 8435 - RNA, 19 nt, artificial
  Completely synthesized
guaggugaaggcuuuuguc

SEQ ID NO: 8436 - RNA, 19 nt, artificial
  Completely synthesized
cucuugugagaugagccuc

SEQ ID NO: 8437 - RNA, 19 nt, artificial
  Completely synthesized
ugaaacguagccgaagaaa

SEQ ID NO: 8438 - RNA, 19 nt, artificial
  Completely synthesized
gauauggagagcuuuugcc

SEQ ID NO: 8439 - RNA, 19 nt, artificial
  Completely synthesized
uuucugcaauucugagcag

SEQ ID NO: 8440 - RNA, 19 nt, artificial
  Completely synthesized
agaaguuucaggugacuga

SEQ ID NO: 8441 - RNA, 19 nt, artificial
  Completely synthesized
gaauugggagaaauucacc

SEQ ID NO: 8442 - RNA, 19 nt, artificial
  Completely synthesized
gagcuuuugcccuaaguuc

SEQ ID NO: 8443 - RNA, 19 nt, artificial
  Completely synthesized
uaguuguaacugagcgaaa

SEQ ID NO: 8444 - RNA, 19 nt, artificial
  Completely synthesized
gauaauugucaacuucugu

SEQ ID NO: 8445 - RNA, 19 nt, artificial
  Completely synthesized
agagcuuuugcccuaaguu

SEQ ID NO: 8446 - RNA, 19 nt, artificial
  Completely synthesized
aacaguuuaaacaguugga

SEQ ID NO: 8447 - RNA, 19 nt, artificial
  Completely synthesized
gaaacuagcccaaauggug

SEQ ID NO: 8448 - RNA, 19 nt, artificial
  Completely synthesized
acuucagaaucacugaggc

SEQ ID NO: 8449 - RNA, 19 nt, artificial
  Completely synthesized
uauucacuaggagaauaag

SEQ ID NO: 8450 - RNA, 19 nt, artificial
  Completely synthesized
cuucagaaucacugaggcc

SEQ ID NO: 8451 - RNA, 19 nt, artificial
  Completely synthesized
cucaaccagcuugucauuu

SEQ ID NO: 8452 - RNA, 19 nt, artificial
  Completely synthesized
uuccgaugaccaggacuua

SEQ ID NO: 8453 - RNA, 19 nt, artificial
  Completely synthesized
gagauaaagaguuguuugc

SEQ ID NO: 8454 - RNA, 19 nt, artificial
  Completely synthesized
caguaggugaaggcuuuug

SEQ ID NO: 8455 - RNA, 19 nt, artificial
  Completely synthesized
ugucaacuucugucaguuu

SEQ ID NO: 8456 - RNA, 19 nt, artificial
  Completely synthesized
agaguuguuugcgaagguc

SEQ ID NO: 8457 - RNA, 19 nt, artificial
  Completely synthesized
ucucaaccagcuugucauu

SEQ ID NO: 8458 - RNA, 19 nt, artificial
  Completely synthesized
cgagauaaagaguuguuug

SEQ ID NO: 8459 - RNA, 19 nt, artificial
  Completely synthesized
ugcugaaggaauccucaaa

SEQ ID NO: 8460 - RNA, 19 nt, artificial
  Completely synthesized
aaaaggcuuucucuugcuc

SEQ ID NO: 8461 - RNA, 19 nt, artificial
  Completely synthesized
acuuggaaccaugguaguc

SEQ ID NO: 8462 - RNA, 19 nt, artificial
  Completely synthesized
cuguugcugauacugggcu

SEQ ID NO: 8463 - RNA, 19 nt, artificial
  Completely synthesized
accaugguagucucaacca

SEQ ID NO: 8464 - RNA, 19 nt, artificial
  Completely synthesized
gaaaaaggcuuucucuugc

SEQ ID NO: 8465 - RNA, 19 nt, artificial
  Completely synthesized
caaauaagggcagcgcucu

SEQ ID NO: 8466 - RNA, 19 nt, artificial
  Completely synthesized
caucuaguuguaacugagc

SEQ ID NO: 8467 - RNA, 19 nt, artificial
  Completely synthesized
aaguuucaggugacugagc

SEQ ID NO: 8468 - RNA, 19 nt, artificial
  Completely synthesized
aaucuaguuuuucuuaaca

SEQ ID NO: 8469 - RNA, 19 nt, artificial
  Completely synthesized
gucagaaucauugaauucu

SEQ ID NO: 8470 - RNA, 19 nt, artificial
  Completely synthesized
ccuaaaucuaguuuuucuu

SEQ ID NO: 8471 - RNA, 19 nt, artificial
  Completely synthesized
aagaaauuguuuacaguua

SEQ ID NO: 8472 - RNA, 19 nt, artificial
  Completely synthesized
gucuucuguggagaggaug

SEQ ID NO: 8473 - RNA, 19 nt, artificial
  Completely synthesized
ucagcuaugaaagcagaau

SEQ ID NO: 8474 - RNA, 19 nt, artificial
  Completely synthesized
cguauuauuuucuauacua

SEQ ID NO: 8475 - RNA, 19 nt, artificial
  Completely synthesized
ggucaaauccuccuaaauc

SEQ ID NO: 8476 - RNA, 19 nt, artificial
  Completely synthesized
ugaccaggacuuacaggca

SEQ ID NO: 8477 - RNA, 19 nt, artificial
  Completely synthesized
ugaagucaacaacagggag

SEQ ID NO: 8478 - RNA, 19 nt, artificial
  Completely synthesized
uccaagcggcuugaauguu

SEQ ID NO: 8479 - RNA, 19 nt, artificial
  Completely synthesized
uguggacuacaguuaccua

SEQ ID NO: 8480 - RNA, 19 nt, artificial
  Completely synthesized
cgaaaaaggcuuucucuug

SEQ ID NO: 8481 - RNA, 19 nt, artificial
  Completely synthesized
aacauacugacacuccaau

SEQ ID NO: 8482 - RNA, 19 nt, artificial
  Completely synthesized
aaagcugcaugcagucauc

SEQ ID NO: 8483 - RNA, 19 nt, artificial
  Completely synthesized
cuuuccgucgcugacugaa

SEQ ID NO: 8484 - RNA, 19 nt, artificial
  Completely synthesized
ugaaagcuuugcaaaguga

SEQ ID NO: 8485 - RNA, 19 nt, artificial
  Completely synthesized
ugacugaaacguagccgaa

SEQ ID NO: 8486 - RNA, 19 nt, artificial
  Completely synthesized
cuuuuaguauaauaguaca

SEQ ID NO: 8487 - RNA, 19 nt, artificial
  Completely synthesized
cacuucagaaucacugagg

SEQ ID NO: 8488 - RNA, 19 nt, artificial
  Completely synthesized
agugaaacuacugauucaa

SEQ ID NO: 8489 - RNA, 19 nt, Artificial
  Completely synthesized
uccacuucagaaucacuga

SEQ ID NO: 8490 - RNA, 19 nt, artificial
  Completely synthesized
cccugucgaaaaaaucauu

SEQ ID NO: 8491 - RNA, 19 nt, artificial
  Completely synthesized
cccauucacaaaagacaaa

SEQ ID NO: 8492 - RNA, 19 nt, artificial
  Completely synthesized
cagcaggacauggauuuga

SEQ ID NO: 8493 - RNA, 19 nt, artificial
  Completely synthesized
ucccugucgaaaaaaucau

SEQ ID NO: 8494 - RNA, 19 nt, artificial
  Completely synthesized
ccugucgaaaaaaucauua

SEQ ID NO: 8495 - RNA, 19 nt, artificial
  Completely synthesized
ggagggguaagaauaaagu

SEQ ID NO: 8496 - RNA, 19 nt, artificial
  Completely synthesized
gcccucaccugcuacuuua

SEQ ID NO: 8497 - RNA, 19 nt, artificial
  Completely synthesized
ucccguuuguagaugacaa

SEQ ID NO: 8498 - RNA, 19 nt, artificial
  Completely synthesized
guaagaagccagauguuaa

SEQ ID NO: 8499 - RNA, 19 nt, artificial
  Completely synthesized
aaugauuuuuucgacaggg

SEQ ID NO: 8500 - RNA, 19 nt, artificial
  Completely synthesized
uuugucuuuugugaauggg

SEQ ID NO: 8501 - RNA, 19 nt, artificial
  Completely synthesized
ucaaauccauguccugcug

SEQ ID NO: 8502 - RNA, 19 nt, artificial
  Completely synthesized
augauuuuuucgacaggga

SEQ ID NO: 8503 - RNA, 19 nt, artificial
  Completely synthesized
uaaugauuuuuucgacagg

SEQ ID NO: 8504 - RNA, 19 nt, artificial
  Completely synthesized
acuuuauucuuaccccucc

SEQ ID NO: 8505 - RNA, 19 nt, artificial
  Completely synthesized
uaaaguagcaggugagggc

SEQ ID NO: 8506 - RNA, 19 nt, artificial
  Completely synthesized
uugucaucuacaaacggga

SEQ ID NO: 8507 - RNA, 19 nt, artificial
  Completely synthesized
uuaacaucuggcuucuuac

SEQ ID NO: 8508 - RNA, 19 nt, artificial
  Completely synthesized
cccuguagaaaaaaucauu

SEQ ID NO: 8509 - RNA, 19 nt, artificial
  Completely synthesized
ccuggaagugucaaacaga

SEQ ID NO: 8510 - RNA, 19 nt, artificial
  Completely synthesized
gggcaaaagcucuccauau

SEQ ID NO: 8511 - RNA, 19 nt, artificial
  Completely synthesized
cuggaagugucaaacagaa

SEQ ID NO: 8512 - RNA, 19 nt, artificial
  Completely synthesized
ugagcuggaaaaacagaaa

SEQ ID NO: 8513 - RNA, 19 nt, artificial
  Completely synthesized
gagcuggaaaaacagaaaa

SEQ ID NO: 8514 - RNA, 19 nt, artificial
  Completely synthesized
acaaaagacaaacauucaa

SEQ ID NO: 8515 - RNA, 19 nt, artificial
  Completely synthesized
cauucacaaaagacaaaca

SEQ ID NO: 8516 - RNA, 19 nt, artificial
  Completely synthesized
gcaggacauggauuugauu

SEQ ID NO: 8517 - RNA, 19 nt, artificial
  Completely synthesized
agcaggacauggauuugau

SEQ ID NO: 8518 - RNA, 19 nt, artificial
  Completely synthesized
gacauggauuugauugaca

SEQ ID NO: 8519 - RNA, 19 nt, artificial
  Completely synthesized
agggcaaaagcucuccaua

SEQ ID NO: 8520 - RNA, 19 nt, artificial
  Completely synthesized
agguugcccacauucccaa

SEQ ID NO: 8521 - RNA, 19 nt, artificial
  Completely synthesized
aaugauuuuuucuacaggg

SEQ ID NO: 8522 - RNA, 19 nt, artificial
  Completely synthesized
ucuguuugacacuuccagg

SEQ ID NO: 8523 - RNA, 19 nt, artificial
  Completely synthesized
auauggagagcuuuugccc

SEQ ID NO: 8524 - RNA, 19 nt, artificial
  Completely synthesized
uucuguuugacacuuccag

SEQ ID NO: 8525 - RNA, 19 nt, artificial
  Completely synthesized
uuucuguuuuuccagcuca

SEQ ID NO: 8526 - RNA, 19 nt, artificial
  Completely synthesized
uuuucuguuuuuccagcuc

SEQ ID NO: 8527 - RNA, 19 nt, artificial
  Completely synthesized
uugaauguuugucuuuugu

SEQ ID NO: 8528 - RNA, 19 nt, artificial
  Completely synthesized
uguuugucuuuugugaaug

SEQ ID NO: 8529 - RNA, 19 nt, artificial
  Completely synthesized
aaucaaauccauguccugc

SEQ ID NO: 8530 - RNA, 19 nt, artificial
  Completely synthesized
aucaaauccauguccugcu

SEQ ID NO: 8531 - RNA, 19 nt, artificial
  Completely synthesized
ugucaaucaaauccauguc

SEQ ID NO: 8532 - RNA, 19 nt, artificial
  Completely synthesized
uauggagagcuuuugcccu

SEQ ID NO: 8533 - RNA, 19 nt, Artificial
  Completely synthesized
uugggaaugugggcaaccu

What is claimed:

1. A double-stranded compound having the structure:
5' $(N)_x$—Z 3' (antisense strand)
3' Z'—$(N')_y$—Z" 5' (sense strand)
wherein each of N and N' is a nucleotide which may be an unmodified or a modified ribonucleotide, or may be an unconventional nucleotide moiety;
wherein each of $(N)_x$ and $(N')_y$ is an oligonucleotide in which each consecutive N or N' is joined to the next N or N' by a covalent bond;
wherein Z and Z' may be present or absent, but if present is independently 1-5 consecutive nucleotides covalently attached at the 3' terminus of the strand in which it is present;
wherein Z" may be present or absent, but if present is a capping moiety covalently attached at the 5' terminus of $(N')_y$;
wherein x=y=19;
wherein $(N)_x$ comprises at least five alternating unmodified and modified ribonucleotides beginning at the 3' end of $(N)_x$ and at least nine modified ribonucleotides and unconventional nucleotide moieties in total and each remaining N is an unmodified ribonucleotide;
wherein $(N')_y$ comprises an unconventional nucleotide moiety which is selected from the group consisting of an L-DNA mirror nucleotide and a nucleotide joined to an adjacent nucleotide by a 2'-5' internucleotide phosphate bond in at least one of the 3' terminal position or the 3' penultimate position; and wherein the sequence of $(N)_x$ is 5' UUGUCAUCUACAAACGGGA 3' (SEQ ID NO: 8,506) and the sequence of $(N)_y$ is 5' UCCCGUUUGUAGAUGACAA 3' (SEQ ID NO: 8,497).

2. The double-stranded compound according to claim 1, wherein $(N')_y$ comprises an L-DNA mirror nucleotide at the 3' terminal position.

3. The double-stranded compound according to claim 1, wherein $(N')_y$ comprises an L-DNA mirror nucleotide at the 3' penultimate position.

4. The double-stranded compound according to claim 1, wherein the modified ribonucleotides in (N)x comprise 2'-O-methyl sugar modified ribonucleotides.

5. The double-stranded compound according to claim 1, wherein the unmodified ribonucleotides are present at positions 2, 4, 6, 8, 10, 12, 14, 16 and 18 and the 2'-O-methyl sugar modified ribonucleotides are present at positions 1, 3, 5, 7, 9, 11, 13, 15, 17 and 19.

6. The double-stranded compound according to claim 4 wherein the unmodified ribonucleotides are present at positions 1, 3, 5, 7, 9, 10, 12, 14, 16 and 18 and the 2'-O-methyl sugar modified ribonucleotide are present at positions 2, 4, 6, 8, 11, 13, 15, 17 and 19.

7. The double-stranded compound according to claim 1 wherein $(N')_y$ further comprises a bicyclic nucleotide.

8. The double-stranded compound according to claim 7 wherein the bicyclic nucleotide is a locked nucleic acid (LNA) or 2'-O, 4'-C-ethylene-bridged nucleic acid (ENA).

9. A composition comprising a pharmaceutically acceptable carrier and a double-stranded compound according to claim 1 in an amount effective to down-regulate expression of a human nuclear factor erythroid-2 related factor 2 (Nrf2) gene.

10. A method of treating a patient suffering from a disorder comprising administering to the patient the composition according to claim 9 in a therapeutically effective dose so as to thereby treat the patient.

11. The method of claim 10, wherein the disorder is cancer or a proliferative disease.

12. The method of claim 11, wherein the cancer is lung cancer.

13. The method according to claim 12, wherein the composition is administered as naked siRNA.

14. The method of claim 13, wherein the naked siRNA is administered via aerosol to the lung of the patient.

15. The method of claim 13, wherein the siRNA is administered via intubation or inhalation to the lung of the patient.

16. The method according to claim 10, further comprising administering to the patient a chemotherapy drug.

17. The method of claim 16, wherein the chemotherapy drug is a compound comprising platinum.

18. The double-stranded compound according to claim 2, wherein (N')y comprises a nucleotide joined to an adjacent nucleotide by a 2'-5' internucleotide phosphate bond at the 3' terminal position.

19. The double-stranded compound according to claim 2, wherein (N')y comprises a nucleotide joined to an adjacent nucleotide by a 2'-5' internucleotide phosphate bond at the 3' penultimate position.

20. The double-stranded compound according to claim 19, wherein (N')y comprises a nucleotide joined to an adjacent nucleotide by a 2'-5' internucleotide phosphate bond in positions 17 and 18.

21. The double-stranded compound of claim 1, wherein one or more of the nucleotides which form the 2'-5' phosphodiester bonds further comprises a 3'-O-methyl sugar modification.

* * * * *